US007812216B2

(12) United States Patent
Allen et al.

(10) Patent No.: US 7,812,216 B2
(45) Date of Patent: Oct. 12, 2010

(54) COMPOSITIONS RELATED TO THE QUANTITATIVE TRAIT LOCUS 6 (QTL6) IN MAIZE AND METHODS OF USE

(75) Inventors: William B. Allen, Urbandale, IA (US); Bo Shen, Johnston, IA (US); Mitchell C. Tarczynski, West Des Moines, IA (US); Mark E. Williams, Newark, DE (US); Peizhong Zheng, Johnston, IA (US); Gan-Yuan Zhong, Urbandale, IA (US)

(73) Assignees: Pioneer Hi-Bred International, Inc., Johnston, IA (US); E.I. duPont de Nemours and Company, Wilmington, DE (US)

( * ) Notice: Subject to any disclaimer, the term of this patent is extended or adjusted under 35 U.S.C. 154(b) by 651 days.

(21) Appl. No.: 11/680,922

(22) Filed: Mar. 1, 2007

(65) Prior Publication Data
US 2007/0266462 A1 Nov. 15, 2007

Related U.S. Application Data

(60) Provisional application No. 60/778,163, filed on Mar. 1, 2006.

(51) Int. Cl.
A01H 1/00 (2006.01)
A01H 5/00 (2006.01)
A01H 5/10 (2006.01)
C12N 15/82 (2006.01)
(52) U.S. Cl. .......... 800/260; 800/264; 800/278; 800/281; 800/295; 800/312; 800/320.1; 800/320.3; 435/412; 435/415; 435/416; 435/419; 536/23.6
(58) Field of Classification Search ............ None
See application file for complete search history.

(56) References Cited

U.S. PATENT DOCUMENTS

| 6,444,876 | B1 | 9/2002 | Lassner et al. |
| 6,552,250 | B1 | 4/2003 | Nykiforuk et al. |
| 6,914,170 | B2 | 7/2005 | Li et al. |
| 7,015,373 | B1 | 3/2006 | Zou et al. |
| 2003/0154524 | A1 | 8/2003 | Foley |
| 2003/0172416 | A1 | 9/2003 | Foley |
| 2003/0204870 | A1 | 10/2003 | Allen et al. |
| 2004/0025202 | A1 | 2/2004 | Laurie et al. |
| 2004/0088759 | A1 | 5/2004 | Cahoon et al. |
| 2005/0204418 | A1 | 9/2005 | Jung et al. |

FOREIGN PATENT DOCUMENTS

| EP | 1 484 392 A2 | 12/2004 |
| WO | WO 95/22598 | 8/1995 |
| WO | WO 98/42870 | 10/1998 |
| WO | WO 00/32756 | 6/2000 |
| WO | WO 00/36114 | 6/2000 |
| WO | WO 00/36114 A1 | 6/2000 |
| WO | WO 01/16308 A2 | 3/2001 |
| WO | WO 02/062129 A2 | 8/2002 |
| WO | WO 2004/101793 A1 | 11/2004 |
| WO | WO 2005/003312 A2 | 1/2005 |
| WO | WO 2005/024017 | 3/2005 |
| WO | WO 2005/063988 | 7/2005 |
| WO | WO 2007/103738 A2 | 9/2007 |

OTHER PUBLICATIONS

Zheng et al., Nature Genetics, vol. 40, No. 3, pp. 367-372.*
Alrefai, et al., "Quantitative Trail Locus Analysis Of Fatty Acid Concentrations in Maize," Genome, 1995, pp. 894-901, vol. 38, No. 5.
Rocheford et al., "Progress Report: Development of High Oil, High Oleic Value-Added Maize Hybrids," Illinois-Missour Biotechnology Alliance, http://www.imba.missouri.edu/report/1998_4.php.
Nucleotide Sequence, DATABASE UniProt [Online], 2004, "Putative acyl-CoA: diacylglycerol acyltransferase," XP-002453444, Accession No. UniProt: Q5Z8Z2.
Berke et al. "Quantitative Trait Loci for Flowering, Plant and Ear Height, and Kernel Traits in Maize," Crop Science, 1995, pp. 1542-1549, vol. 35.
Goldman et al., "Molecular Markers Associated with Maize Kernel Oil Concentration in an Illinois High Protein x Illinois Low Protein Cross" Crop Science, 1994, pp. 908-915, vol. 34.
He et al., "Regulation of Diacylglycerol Acyltransferase in Developing Seeds of Castor," Lipids, 2004, pp. 865-871, vol. 39, No. 9.
Jako et al., "Seed-Specific Over-Expression of an Arabidopsis cDNA Encoding a Diacylglycerol Acyltransferase Enhances Seed Oil Content and Seed Weight" Plant Physiology, 2001, pp. 861-874, vol. 126.
Laurie et al., "The Genetic Architecture of Response to Long-Term Artificial Selection for Oil Concentration in the Maize Kernel" Genetics, 2004, pp. 2141-2155, vol. 168.

(Continued)

Primary Examiner—Eileen B O Hara
(74) Attorney, Agent, or Firm—Alston & Bird LLP

(57) ABSTRACT

Compositions related to the quantitative trait locus 6 (QTL6) in maize and methods for their use are provided. The compositions are novel molecular marker loci that are genetically linked with QTL6 and which are associated with increased oil content and/or increased oleic acid content and/or an increased oleic acid/linoleic acid ratio of a plant or plant part thereof. These novel markers are characterized by the presence of at least one polymorphism relative to the corresponding marker locus from the QTL6 region of non-high-oil, non-high-oleic acid maize plants. In some embodiments, the novel marker loci comprise coding sequence for a maize DGAT1-2 polypeptide or biologically active variant thereof. The marker loci of the invention, and suitable fragments thereof, are useful in methods of the invention for manipulating oil and/or oleic acid content and/or oleic acid/lineolic acid ratio of a plant or plant part thereof, for marker-assisted selection of a plant, for example, a maize plant, or plant part thereof, having an increased oil content and/or increased oleic acid content and/or an increased oleic acid/linoleic acid ratio, and for marker-assisted breeding of the high oil and/or high oleic acid trait.

31 Claims, 69 Drawing Sheets

OTHER PUBLICATIONS

Lee et al., "*Arabidopsis* Leafy Cotyledon 1 Represents a Functionally Specialized Subunit of the CCAAT Binding Transcription Factor," *PNAS*, 2003, pp. 2152-2156, vol. 100, No. 4.

Neelam et al., "Functional Characterization and Expression Analysis of the Amino Acid Permease RcAAP3 from Castor Bean," *Plant Physiology*, 1999, pp. 1049-1056, vol. 120.

Routaboul et al., "The *TAG1* i Locus of *Arabidopsis* Encodes for a Diacylglycerol Acyltransferase," *Plant Physiol. Biochem*, 1999, pp. 831-840, vol. 37, No. 11.

Song et al., "Long Term Selection for Oil Concentration in Five Maize Populations," *Maydica*, 2004, pp. 9-14, vol. 49.

Song et al., "QTL Mapping of Kernel Oil Concentration with High-Oil Maize by SSR Markers," *Maydica*, 2004, pp. 41-48, vol. 49.

NCBI Report for Accession No. BAD53762, Direct Submission on May 30, 2001.

NCBI Report for Accession No. AAV59457, Direct Submission on Oct. 16, 2002.

NCBI Report for Accession No. AAW51456, Direct Submission on Dec. 16, 2004.

NCBI Report for Accession No. AAS01606, Direct Submission on Oct. 23, 2003.

NCBI Report for Accession No. AAG23696, Direct Submission on Aug. 23, 2000.

NCBI Report for Accession No. AAF19345, Direct Submission on Feb. 17, 1999.

NCBI Report for Accession No. AAY40784, Direct Submission on Apr. 22, 2005.

NCBI Report for Accession No. AAY40785, Direct Submission on Apr. 22, 2005.

NCBI Report for Accession No. CAB45373, Direct Submission on Apr. 6, 1999.

NCBI Report for Accession No. AAR11479, Direct Submission on Aug. 13, 2003.

NCBI Report for Accession No. Q8W3G2, Direct Submission in Mar. 2000.

NCBI Report for Accession No. AAF64066, Direct Submission on Apr. 4, 2000.

NCBI Report for Accession No. BAA00575, Direct Submission on Sep. 3, 1990.

NCBI Report for Accession No. CAA41769, Direct Submission on Apr. 10, 1991.

NCBI Report for Accession No. CAA56159, Direct Submission on Jun. 13, 1994.

NCBI Report for Accession No. ABB47826, Direct Submission on May 5, 2003.

NCBI Report for Accession No. Q8GXU8, Mar. 1, 2003.

NCBI Report for Accession No. Q9LLY4, Oct. 1, 2000.

NCBI Report for Accession No. Q42670, Nov. 1, 1996.

NCBI Report for Accession No. AAQ89590, Direct Submission on Sep. 8, 2003.

NCBI Report for Accession No. $XP_{13}$ 467452, Direct Submission on Jul. 1, 2004.

NCBI Report for Accession No. NP_566952, Apr. 20, 2007.

NCBI Report for Accession No. BAD33251, Direct Submission on Feb. 13, 2002.

NCBI Report for Accession No. AAS78662, Direct Submission on Dec. 8, 2003.

NCBI Report for Accession No. AAV31083, Direct Submission on Sep. 14, 2004.

NCBI Report for Accession No. ABB84383, Direct Submission on Nov. 3, 2005.

NCBI Report for Accession No. AAM03340, Direct Submission on Mar. 12, 2002.

NCBI Report for Accession No. ABE24124, U.S. Patent No. 7,015,373, Mar. 21, 2006.

NCBI Report for Accession No. ABE24129, U.S. Patent No. 7,015,373, Mar. 21, 2006.

NCBI Report for Accession No. ABE24132, U.S. Patent No. 7,015,373, Mar. 21, 2006.

NCBI Report for Accession No. ABE24128, U.S. Patent No. 7,015,373, Mar. 21, 2006.

NCBI Report for Accession No. ABE24126, U.S. Patent No. 7,015,373, Mar. 21, 2006.

NCBI Report for Accession No. ABA16063, U.S. Patent No. 6,914,170, Jul. 5, 2005.

NCBI Report for Accession No. AAN88709, U.S. Patent No. 6,444,876, Sep. 3, 2002.

NCBI Report for Accession No. AAN88710, U.S. Patent No. 6,444,876, Sep. 3, 2002.

NCBI Report for Accession No. AAQ41961, U.S. Patent No. 6,579,974, Jun. 17, 2003.

NCBI Report for Accession No. AAQ41962, U.S. Patent No. 6,579,974, Jun. 17, 2003.

NCBI Report for Accession No. BD298892, U.S. Appl. No. 60/152,493, filed Aug. 30, 1999.

NCBI Report for Accession No. AR227747, U.S. Patent No. 6,444,876, Sep. 3, 2002.

NCBI Report for Accession No. BD241852, U.S. Appl. No. 60/088,143, filed Jun. 5, 1998.

NCBI Report for Accession No. AX090357, WO/0116308, Mar. 8, 2001.

NCBI Report for Accession No. CQ963627, EP 1484392, Dec. 8, 2004.

NCBI Report for Accession No. DD091045, U.S. Appl. No. 60/475,371, filed Jun. 3, 2003.

NCBI Report for Accession No. BD298887, U.S. Appl. No. 60/152,493, filed Aug. 30, 1999.

NCBI Report for Accession No. AR227742, U.S. Patent No. 6,444,876, Sep. 3, 2002.

NCBI Report for Accession No. BD241847, U.S. Appl. No. 60/088,143, filed Jun. 5, 1998.

NCBI Report for Accession No. AX090352, WO 0116308, Mar. 8, 2001.

NCBI Report for Accession No. AY110660, Direct Submission on Apr. 25, 2002.

NCBI Report for Accession No. DY620301, Mar. 7, 2006.

NCBI Report for Accession No. DR966019, Aug. 3, 2005.

NCBI Report for Accession No. BG321213, Feb. 27, 2001.

www.ebi.ac.uk; Database EMBL; Accession No. CC834562; Jul. 24, 2003.

Kinney et al., "Manipulating Desaturase Activities in Transgenic Crop Plants," *Biochemical Society Transactions*, 2002, pp. 1099-1103, vol. 30, No. 6.

Mangolin, et al., "Mapping QTLs for Kernal Oil Content in a Tropical Maize Population," *Euphytica*, 2004, pp. 251-259, vol. 137, No. 2.

* cited by examiner

BC3S2 NILs

|         | Emb oil % | Seed % Oil |
|---------|-----------|------------|
| QTL6+/+ | 35.8      | 5.1        |
| QTL6 -/-| 31.6      | 4.4        |
| Change  | 4.1       | 0.8        |
| % Change| 13.1      | 17.4       |
| P Value | 1.9E-07   | 1.3E-04    |

BC4S2 NILs

|         | Emb oil % | Seed % Oil |
|---------|-----------|------------|
| QTL6+/+ | 33.3      | 4.4        |
| QTL6-/- | 28.7      | 3.7        |
| Change  | 4.7       | 0.7        |
| % Change| 16.2      | 19.2       |
| P value | 9.7E-18   | 2.1E-11    |

FIGURE 3

BC3S2 NILs

|  | R18:1(%) | R18:2(%) |
|---|---|---|
| QTL6+/+ | 36.2 | 46.4 |
| QTL6-/- | 24.6 | 58.5 |
| Change | 11.6 | -12.1 |
| % Change | 47.0 | -20.6 |
| P Value | 4.0E-11 | 9.0E-11 |

BC4S2 NILs

|  | R18:1(%) | R18:2(%) |
|---|---|---|
| QTL6+/+ | 37.9 | 45.4 |
| QTL6-/- | 23.6 | 59.8 |
| Change | 14.4 | -14.4 |
| % Change | 61.0 | -24.1 |
| P Value | 1.4E-07 | 3.0E-07 |

FIGURE 4

|  | Emb oil % | kernel oil % |
|---|---|---|
| QTL6 | | |
| -/- | 30.1 | 3.9 |
| +/+ | 35.1 | 4.9 |
| LEC1 | | |
| -/- | 26.8 | 3.7 |
| +/+ | 35.1 | 4.6 |
| QTL6/LEC1 | | |
| +/-, +/- | 39.7 | 6.1 |

FIGURE 5

QTL6 BAC05
Forward primer (86488): 5'-CGAGAAAAGCCTATTGACTTGAGAA
Reverse primer (86489): 5'-TTGCATAGCCATTCCTTACGTAGTT
Marker sequences and alignment:

```
BAC05-ASK   (1)
BAC05-EF09B (1)

BAC05-ASK   (51)
BAC05-EF09B (51)

BAC05-ASK   (101)
BAC05-EF09B (101)

BAC05-ASK   (149)
BAC05-EF09B (151)

BAC05-ASK   (199)
BAC05-EF09B (201)

BAC05-ASK   (249)
BAC05-EF09B (251)

BAC05-ASK   (299)
BAC05-EF09B (301)

BAC05-ASK   (349)
BAC05-EF09B (351)

BAC05-ASK   (399)
BAC05-EF09B (400)

BAC05-ASK   (449)
BAC05-EF09B (450)

BAC05-ASK   (499)
BAC05-EF09B (500)
```

FIGURE 7

QTL6 BAC17
Forward primer (86512): 5'-CAGATTAACATGTCAATGCATTACC
Reverse primer (86513): 5'-GCTTGTAACCCCTTTCCTAACATG
Marker sequences and alignment:

```
BAC17-ASK    (1)
BAC17-EF09B  (1)

BAC17-ASK    (51)
BAC17-EF09B  (51)

BAC17-ASK    (101)
BAC17-EF09B  (101)

BAC17-ASK    (151)
BAC17-EF09B  (151)

BAC17-ASK    (201)
BAC17-EF09B  (201)

BAC17-ASK    (251)
BAC17-EF09B  (251)

BAC17-ASK    (301)
BAC17-EF09B  (301)

BAC17-ASK    (351)
BAC17-EF09B  (351)

BAC17-ASK    (401)
BAC17-EF09B  (401)

BAC17-ASK    (451)
BAC17-EF09B  (451)

BAC17-ASK    (501)
BAC17-EF09B  (501)
```

FIGURE 8

QTL6 BAC18
Forward primer (86514): 5'- GCACTTGTTTGCAACAACTACTATTGT
Reverse primer (86515): 5'- GGATCAACTTTTGAACGTGGTGCT
Marker sequences and alignment:

QTL6 BAC20
Forward primer (86518): 5'- TGTATGTGCTTGCGCGTTACG
Reverse primer (86519): 5'- CACCCTAGGCAGGAGATGGAGT
Marker sequences and alignment:

```
BAC20-ASK    (1)
BAC20-EF09B  (1)

BAC20-ASK   (51)                                                A
BAC20-EF09B (51)                                                G

BAC20-ASK  (101)
BAC20-EF09B(101)

BAC20-ASK  (151)                                          T
BAC20-EF09B(151)                                          C

BAC20-ASK  (201)              G                    T
BAC20-EF09B(201)              A                    C

BAC20-ASK  (251)    C                G
BAC20-EF09B(251)    T                A

BAC20-ASK  (301)     C AGGATGGCCTCGGGCGTGTCGTGACTGTGTCTCCCGCCGGGAG
BAC20-EF09B(301)     T  ------------------------------------------

BAC20-ASK  (351) TTGGCCTCGAACGAGTCGTGACTGTCTGCCCCCCCA
BAC20-EF09B(308) ------------------------------------

BAC20-ASK  (401)             C
BAC20-EF09B(322)             T

BAC20-ASK  (451)              A
BAC20-EF09B(372)              G

BAC20-ASK  (501)
BAC20-EF09B(422)
```

FIGURE 10

QTL6 BAC22
```
Forward primer (86522): 5'- AACTAGGCATACGGATTTAAAATTTCC
Reverse primer (86523): 5'- CATGTCCAAGTTCGTGTGGTATTTTTC
Marker sequences and alignment:
```

BAC22-ASK    (1)
BAC22-EF09B  (1)

BAC22-ASK    (49)
BAC22-EF09B  (51)

BAC22-ASK    (99)
BAC22-EF09B  (101)

BAC22-ASK    (149)
BAC22-EF09B  (151)

BAC22-ASK    (199)
BAC22-EF09B  (201)

FIGURE 11

QTL6 BAC24
Forward primer (86526): 5'- ATCTTAGGACTGGTGGAATGCCAAA
Reverse primer (86527): 5'- GGCTGACAAAAAATAGACTAATTGTCAG
Marker sequences and alignment:

```
BAC24-ASK     (1)
BAC24-EF09B   (1)

BAC24-ASK    (51)
BAC24-EF09B  (51)

BAC24-ASK   (101)
BAC24-EF09B (101)

BAC24-ASK   (151)
BAC24-EF09B (151)

BAC24-ASK   (201)
BAC24-EF09B (201)

BAC24-ASK   (251)
BAC24-EF09B (251)

BAC24-ASK   (297)
BAC24-EF09B (301)

BAC24-ASK   (347)
BAC24-EF09B (351)
```

FIGURE 12

QTL6 BAC29
Forward primer (86536): 5'- TAACAGTGGGACGGCAAAGAACTAG
Reverse primer (86537): 5'- TGAGCTTTCCTTGACCATAACAAGG
Marker sequences and alignment:

BAC29-ASK   (1)
BAC29-EF09B (1)

BAC29-ASK   (51)
BAC29-EF09B (51)

BAC29-ASK   (101)
BAC29-EF09B (101)

BAC29-ASK   (151)
BAC29-EF09B (151)

BAC29-ASK   (201)
BAC29-EF09B (201)

BAC29-ASK   (251)
BAC29-EF09B (251)

BAC29-ASK   (301)
BAC29-EF09B (301)

BAC29-ASK   (351)
BAC29-EF09B (351)

BAC29-ASK   (401)
BAC29-EF09B (401)

BAC29-ASK   (451)
BAC29-EF09B (451)

BAC29-ASK   (501)
BAC29-EF09B (501)

FIGURE 13

QTL6 BAC32
Forward primer (86542): 5'- TGAAGATGTACACAAATGAATTGCG
Reverse primer (86543): 5'- GTCAAATGTCTCCAGCAGATTGTG
Marker sequences and alignment:

QTL6SNP7
```
Forward primer (96066): 5'- TGACACGTCGCCGTAGCAACCA
Reverse primer (96067): 5'- TTGAAGCTGCCAGGGTCGGTCT
Marker sequences and alignment:
```

| | |
|---|---|
| QTL6SNP7-ASK | (1) |
| QTL6SNP7-EF09B | (1) |
| QTL6SNP7-ASK | (51) |
| QTL6SNP7-EF09B | (51) |
| QTL6SNP7-ASK | (101) |
| QTL6SNP7-EF09B | (101) |
| QTL6SNP7-ASK | (151) |
| QTL6SNP7-EF09B | (151) |
| QTL6SNP7-ASK | (201) |
| QTL6SNP7-EF09B | (201) |
| QTL6SNP7-ASK | (251) |
| QTL6SNP7-EF09B | (251) |
| QTL6SNP7-ASK | (301) |
| QTL6SNP7-EF09B | (301) |
| QTL6SNP7-ASK | (351) |
| QTL6SNP7-EF09B | (351) |
| QTL6SNP7-ASK | (401) |
| QTL6SNP7-EF09B | (401) |
| QTL6SNP7-ASK | (451) |
| QTL6SNP7-EF09B | (451) |
| QTL6SNP7-ASK | (501) |
| QTL6SNP7-EF09B | (501) |

FIGURE 15

QTL6SNP8
```
Forward primer (96068): 5'- GGCTTTGGGGGTGCGATACTT
Reverse primer (96069): 5'- CGGTTCACTCTCGCTCATGTAAGT
Marker sequences and alignment:
```

QTL6SNP8-ASK   (1)
QTL6SNP8-EF09B (1)

QTL6SNP8-ASK   (51)
QTL6SNP8-EF09B (51)

QTL6SNP8-ASK   (101)
QTL6SNP8-EF09B (101)

QTL6SNP8-ASK   (151)
QTL6SNP8-EF09B (151)

QTL6SNP8-ASK   (201)
QTL6SNP8-EF09B (201)

QTL6SNP8-ASK   (251)
QTL6SNP8-EF09B (251)

QTL6SNP8-ASK   (298)
QTL6SNP8-EF09B (301)

QTL6SNP8-ASK   (348)
QTL6SNP8-EF09B (351)

QTL6SNP8-ASK   (398)
QTL6SNP8-EF09B (401)

QTL6SNP8-ASK   (448)
QTL6SNP8-EF09B (451)

QTL6SNP8-ASK   (498)
QTL6SNP8-EF09B (501)

FIGURE 16

QTL6SNP9
Forward primer (96070): 5'- CCACCACACATAACTAGACTCGTCTG
Reverse primer (96071): 5'- ACACTCTGTTTGAGGTCTGAGGAAA
Marker sequences and alignment:

```
QTL6SNP9-ASK    (1)                                                   CCA
QTL6SNP9-EF09B  (1)                                                   ACG

QTL6SNP9-ASK   (51)       G  T
QTL6SNP9-EF09B (51)       T  A  C

QTL6SNP9-ASK  (100)  C                              T
QTL6SNP9-EF09B(101)  T                              C

QTL6SNP9-ASK  (150)          -  A  A    G  AC
QTL6SNP9-EF09B(151)          C  G    A  --

QTL6SNP9-ASK  (199)     --  C              G     G
QTL6SNP9-EF09B(199)     GA  T              T     A

QTL6SNP9-ASK  (247)     T        C        A      G
QTL6SNP9-EF09B(249)     -        T        G      C

QTL6SNP9-ASK  (297)          C      T        C
QTL6SNP9-EF09B(298)       Y  C      C        T

QTL6SNP9-ASK  (347)    T           T  A  A C
QTL6SNP9-EF09B(348)    C           A  G  G A

QTL6SNP9-ASK  (397)   T
QTL6SNP9-EF09B(398)   W

QTL6SNP9-ASK  (447)
QTL6SNP9-EF09B(448)
```

FIGURE 17

QTL6SNP13
```
Forward primer (96080): 5'- CTCGCGTTAACCACGCAACACAAAG
Reverse primer (96081): 5'- GGCGTGGCCGATTCGATTCT
Marker sequences and alignment:

QTL6SNP13-ASK    (1)
QTL6SNP13-EF09B  (1)

QTL6SNP13-ASK    (51)
QTL6SNP13-EF09B  (51)

QTL6SNP13-ASK    (101)
QTL6SNP13-EF09B  (101)

QTL6SNP13-ASK    (151)
QTL6SNP13-EF09B  (151)

QTL6SNP13-ASK    (201)
QTL6SNP13-EF09B  (201)

QTL6SNP13-ASK    (251)
QTL6SNP13-EF09B  (251)

QTL6SNP13-ASK    (301)
QTL6SNP13-EF09B  (301)

QTL6SNP13-ASK    (351)
QTL6SNP13-EF09B  (351)

QTL6SNP13-ASK    (401)
QTL6SNP13-EF09B  (399)

QTL6SNP13-ASK    (450)
QTL6SNP13-EF09B  (449)

QTL6SNP13-ASK    (500)
QTL6SNP13-EF09B  (499)
```

FIGURE 18

QTL6SNP14
Forward primer (96082): 5'- CTGTCATGGACTAGGTAACCAACTCG
Reverse primer (96083): 5'- GCAGCAGATGTCGTCACTGACAG
Marker sequences and alignment:

```
QTL6SNP14-ASK   (1)
QTL6SNP14-EF09B (1)

QTL6SNP14-ASK   (50)
QTL6SNP14-EF09B (51)

QTL6SNP14-ASK   (100)
QTL6SNP14-EF09B (101)

QTL6SNP14-ASK   (150)
QTL6SNP14-EF09B (151)

QTL6SNP14-ASK   (200)
QTL6SNP14-EF09B (201)

QTL6SNP14-ASK   (250)
QTL6SNP14-EF09B (251)

QTL6SNP14-ASK   (300)
QTL6SNP14-EF09B (301)

QTL6SNP14-ASK   (350)
QTL6SNP14-EF09B (351)

QTL6SNP14-ASK   (400)
QTL6SNP14-EF09B (401)

QTL6SNP14-ASK   (450)
QTL6SNP14-EF09B (451)

QTL6SNP14-ASK   (500)
QTL6SNP14-EF09B (501)
```

FIGURE 19

QTL6SNP15
Forward primer (96084): 5'- CCGCAACAGCTAGTCAGCAGA
Reverse primer (96085): 5'- TGAGGCGGTACTTGGGCTCG
Marker sequences and alignment:

```
QTL6SNP15-ASK   (1)
QTL6SNP15-EF09B (1)

QTL6SNP15-ASK   (51)
QTL6SNP15-EF09B (51)

QTL6SNP15-ASK   (101)
QTL6SNP15-EF09B (101)

QTL6SNP15-ASK   (151)
QTL6SNP15-EF09B (151)

QTL6SNP15-ASK   (201)
QTL6SNP15-EF09B (201)

QTL6SNP15-ASK   (251)
QTL6SNP15-EF09B (251)

QTL6SNP15-ASK   (301)
QTL6SNP15-EF09B (301)

QTL6SNP15-ASK   (351)
QTL6SNP15-EF09B (351)

QTL6SNP15-ASK   (401)
QTL6SNP15-EF09B (401)
```

FIGURE 20

QTL6SNP16
Forward primer (96086): 5'- TTTTGTGCACTCGGTACACTGAAG
Reverse primer (96087): 5'- CAGGACGTGTGTACGTACTCCGAT
Marker sequences and alignment:

```
QTL6SNP16-ASK    (1)
QTL6SNP16-EF09B  (1)

QTL6SNP16-ASK    (51)
QTL6SNP16-EF09B  (51)

QTL6SNP16-ASK   (101) C
QTL6SNP16-EF09B (101) T

QTL6SNP16-ASK   (151)         T T                            GG
QTL6SNP16-EF09B (151)         C A                            RM

QTL6SNP16-ASK   (201)              T                         A
QTL6SNP16-EF09B (201)              C                         G

QTL6SNP16-ASK   (251) T T
QTL6SNP16-EF09B (251) C G

QTL6SNP16-ASK   (301)    T                      C
QTL6SNP16-EF09B (301)    Y                      M

QTL6SNP16-ASK   (351) C
QTL6SNP16-EF09B (351) T

QTL6SNP16-ASK   (401)
QTL6SNP16-EF09B (401)

QTL6SNP16-ASK   (451) C     T C
QTL6SNP16-EF09B (451) T     C S

QTL6SNP16-ASK   (501)
QTL6SNP16-EF09B (501)
```

FIGURE 21

QTL6SNP17
Forward primer (96088): 5'- CGGGCCTGTGATCCTGCTGCTCTT
Reverse primer (96089): 5'- CACGCCGAAGCCGACGATGT
Marker sequences and alignment:

```
QTL6SNP17-ASK    (1)
QTL6SNP17-EF09B  (1)

QTL6SNP17-ASK    (51)
QTL6SNP17-EF09B  (51)

QTL6SNP17-ASK    (101)
QTL6SNP17-EF09B  (101)

QTL6SNP17-ASK    (151)
QTL6SNP17-EF09B  (146)

QTL6SNP17-ASK    (201)
QTL6SNP17-EF09B  (196)

QTL6SNP17-ASK    (247)
QTL6SNP17-EF09B  (246)

QTL6SNP17-ASK    (297)
QTL6SNP17-EF09B  (296)

QTL6SNP17-ASK    (345)
QTL6SNP17-EF09B  (345)

QTL6SNP17-ASK    (395)
QTL6SNP17-EF09B  (395)

QTL6SNP17-ASK    (445)
QTL6SNP17-EF09B  (445)

QTL6SNP17-ASK    (495)
QTL6SNP17-EF09B  (495)
```

FIGURE 22

MZA5002
```
Forward primer (82263): 5'- AAGTCGCGCGAGTTCATGGT
Reverse primer (82264): 5'- TTATTCCTGCATCATCATCCAC
Marker sequences and alignment:
```

FIGURE 23

MZA13321
Forward primer (82328): 5'-CAGCAAGGAGCTGAGACAAAT
Reverse primer (82329): 5'-AGCAAACAAGTTTTTGGTGGC
Marker sequences and alignment:

```
        MZA13321-ASK      (1)
MZA13321-EF09B(Partial)   (1)

MZA13321-ASK     (51)
MZA13321-EF09B(Partial)  (51)

MZA13321-ASK    (101)
MZA13321-EF09B(Partial) (101)

MZA13321-ASK    (151)
MZA13321-EF09B(Partial) (151)

MZA13321-ASK    (201)
MZA13321-EF09B(Partial) (201)

MZA13321-ASK    (251)
MZA13321-EF09B(Partial) (251)

MZA13321-ASK    (301)
MZA13321-EF09B(Partial) (301)

MZA13321-ASK    (351)
MZA13321-EF09B(Partial) (351)

MZA13321-ASK    (401)
MZA13321-EF09B(Partial) (401)

MZA13321-ASK    (451)                             TGTTTGCTGAATTTACTTTTCAATTT
```

FIGURE 24A

```
MZA13321-EF09B(Partial)    (451)  ░░░░░░░░░░░░░░░░░░░░░░░░------------------------

MZA13321-ASK    (501)  AACAATATATTTGTCCTGTTCGTGTTTCTTAATTCAGAAAAGAGGAATGC
MZA13321-EF09B(Partial)    (475)  --------------------------------------------------

MZA13321-ASK    (551)  CATTCCATTTTTGTCGATGCATTTGCTTCCATGTTCCGTTTTAATATGTT
MZA13321-EF09B(Partial)    (475)  --------------------------------------------------

MZA13321-ASK    (601)  ATGTTGGCATCTGATTTTATCCGGTCATCTCATTGGTGTTTTTGCTTTAC
MZA13321-EF09B(Partial)    (475)  --------------------------------------------------

MZA13321-ASK    (651)  CTGATACATTGAGCAGGAGTCCTTCGATGCATCAAAACCGGTAACATCTG
MZA13321-EF09B(Partial)    (475)  --------------------------------------------------

MZA13321-ASK    (701)  ATGATATACATTCATTCTTCGAGAATCTTGCTAAGAAGAAGAAACAGAGG
MZA13321-EF09B(Partial)    (475)  --------------------------------------------------

MZA13321-ASK    (751)  TTATCTTAGCTTTTGTGACCGCATCGGACCCCACCTGAGGCAATCGTTCT
MZA13321-EF09B(Partial)    (475)  --------------------------------------------------

MZA13321-ASK    (801)  GCTGGACAGAGGTCCTAGTTTGTTGGGCTAGTAAATGTAATGTTATCTTA
MZA13321-EF09B(Partial)    (475)  --------------------------------------------------

MZA13321-ASK    (851)  GGTGGTACTTACTAATCGGGCCAATAATGTTGAATTCTAGCTGGAACGCG
MZA13321-EF09B(Partial)    (475)  --------------------------------------------------

MZA13321-ASK    (901)  GTAATGTAATGATGCACCGAAGTCGCTTGCAGTAGGTTCCCGATGCCCCA
MZA13321-EF09B(Partial)    (475)  --------------------------------------------------

MZA13321-ASK    (951)  AGCCACCAAAAACTTGTTTGCT
MZA13321-EF09B(Partial)    (475)  ----------------------
```

FIGURE 24B

MZA15785
Forward primer (82326): 5'-CCCAGCTCAACAAGGACG
Reverse primer (82327): 5'-CTGTATCTGCAAAACGAGAAG
Marker sequences and alignment:

MZA13118

Forward primer (82324): 5'-GGCGATGCAGAAGGTCGG
Reverse primer (82325): 5'-TAAGCTCATGGATACACCGG

MZA11771

Forward primer (82314): 5'-AGGTCACTGAACCAAATCAG
Reverse primer (82315): 5'-GGATATAGACTGAAAGGGAA

MZA9351

```
Forward primer (82334): 5'-ATGACCTTGACTCTCCCAAG
Reverse primer (82335): 5'-AGATGCATACATACTACATCTG MZA9351-ASK     (1)  ATGACCTTGACTCTCCCAAGGTTTGTTCTTAGAATATTGTCTTATGGTAG
MZA9351-EF09B(Partial)  (1)  --------------------------------------------------

MZA9351-ASK    (51)  GCTAATATTATGCAATCCGCTTCAGTTGGAAAGTTGATGAATTTATTATA
MZA9351-EF09B(Partial)  (1)  --------------------------------------------------

MZA9351-ASK   (101)  TTGGGTGCTGCGTTGTTCTTAAAAATTTCAACCCAAACACAAAGTATGTT
MZA9351-EF09B(Partial)  (1)  --------------------------------------------------

MZA9351-ASK   (151)  ATAAGGAATCCTGCCCCCCCGCCCTCTAATTTAACTTAATTTTTTTCTTA
MZA9351-EF09B(Partial)  (1)  --------------------------------------------------

MZA9351-ASK   (201)  CTTATAAAGTAGACTGCATATGAACATACTGGTAAATAAATGTAGATTAA
MZA9351-EF09B(Partial)  (1)  --------------------------------------------------

MZA9351-ASK   (251)  TTGAGGAAAAAATAATGGTCAGTAGGTCCCCCAAC
MZA9351-EF09B(Partial)  (1)  -----------------------------------

MZA9351-ASK   (301)
MZA9351-EF09B(Partial) (16)

MZA9351-ASK   (351)
MZA9351-EF09B(Partial) (66)

MZA9351-ASK   (401)
MZA9351-EF09B(Partial)(116)

MZA9351-ASK   (451)
MZA9351-EF09B(Partial)(166)

MZA9351-ASK   (501)
MZA9351-EF09B(Partial)(216)

MZA9351-ASK   (551)
MZA9351-EF09B(Partial)(266)

MZA9351-ASK   (601)
MZA9351-EF09B(Partial)(316)

MZA9351-ASK   (651)
MZA9351-EF09B(Partial)(366)

MZA9351-ASK   (701)
MZA9351-EF09B(Partial)(416)

MZA9351-ASK   (751)
MZA9351-EF09B(Partial)(466)
```

FIGURE 28

MZA8135

Forward primer (82336): 5'-CTGCGCATGTTGTATTCTCAT
Reverse primer (82337): 5'-TCAACAAACAGATGGCTGTGG

| | | |
|---|---|---|
| MZA8135-ASK | (1) | |
| MZA8135-EF09B | (1) | |
| MZA8135-ASK | (51) | |
| MZA8135-EF09B | (51) | |
| MZA8135-ASK | (101) | |
| MZA8135-EF09B | (100) | |
| MZA8135-ASK | (151) | |
| MZA8135-EF09B | (150) | |
| MZA8135-ASK | (201) | |
| MZA8135-EF09B | (200) | |
| MZA8135-ASK | (251) | |
| MZA8135-EF09B | (250) | |
| MZA8135-ASK | (301) | |
| MZA8135-EF09B | (300) | |
| MZA8135-ASK | (349) | |
| MZA8135-EF09B | (350) | |
| MZA8135-ASK | (399) | |
| MZA8135-EF09B | (398) | |
| MZA8135-ASK | (449) | |
| MZA8135-EF09B | (448) | |
| MZA8135-ASK | (499) | |
| MZA8135-EF09B | (496) | |

FIGURE 29

ZmDGAT1-2 Amino Acid Alignments

```
                           1                                                  50
ZmDGAT1-2(ASK)      (1)    MAPPPSMPAASDRAGPGRDAGDSSSLRLRRAPSADAGDLAGDSSGGLREN
ZmDGAT1-2(EF09B)    (1)    MAPPPSMPAASDRAGPGRDAGDSSSLRLRPAPSADAGDLAGDSSVGLREN
ZmDGAT1-2(Mo17)     (1)    MAPPPSMPAASDRAGPGRDAGDSSSLRLRPAPSADAGDLAGDSSVGLREN
ZmDGAT1-2(B73)      (1)    MAPPPSMPAASDRAGPGRDAGDSSSLRLRPAPSADAGDLAGDSSVGLREN
      Consensus     (1)    MAPPPSMPAASDRAGPGRDAGDSSSLRLRRAPSADAGDLAGDSSVGLREN
                          51                                                 100
ZmDGAT1-2(ASK)     (51)    GEPQSPTNPPPQEQQQ-HEMLYYRASAPAHRRVKESPLSSDAIFRQSHAG
ZmDGAT1-2(EF09B)   (51)    GEPQPPTNPPPQEQQQQHEMLYYRASAPAHRRVKESPLSSDAIFRQSHAG
ZmDGAT1-2(Mo17)    (51)    GEPQPPTNPPPQEQQQQHEMLYYRASAPAHRRVKESPLSSDAIFRQSHAG
ZmDGAT1-2(B73)     (51)    GEPQPPTNPPPQEQQQQHEMLYYRASAPAHRRVKESPLSSDAIFRQSHAG
      Consensus    (51)    GEPQPPTNPPPQEQQQQHEMLYYRASAPAHRRVKESPLSSDAIFRQSHAG
                         101                                                 150
ZmDGAT1-2(ASK)    (100)    LLNLCIVVLIAVNSRLIIENLMKYGLLIRAGFWFSARSLGDWPLLMCCLT
ZmDGAT1-2(EF09B)  (101)    LLNLCIVVLIAVNSRLIIENLMKYGLLIRAGFWFSARSLGDWPLLMCCLT
ZmDGAT1-2(Mo17)   (101)    LLNLCIVVLIAVNSRLIIENLMKYGLLIRAGFWFSARSLGDWPLLMCCLT
ZmDGAT1-2(B73)    (101)    LLNLCIVVLIAVNSRLIIENLMKYGLLIRAGFWFSARSLGDWPLLMCCLT
      Consensus   (101)    LLNLCIVVLIAVNSRLIIENLMKYGLLIRAGFWFSARSLGDWPLLMCCLT
                         151                                                 200
ZmDGAT1-2(ASK)    (150)    LPVFPLVALMAEKLITRKLIGEHVVILLHIIITTSAIVYPVVVTLKCDSA
ZmDGAT1-2(EF09B)  (151)    LPVFPLVALMAEKLITRKLIGEHVVILLHIIITTSAIVYPVVVTLKCDSA
ZmDGAT1-2(Mo17)   (151)    LPVFPLVALMAEKLITRKLIGEHVVILLHIIITTSAIVYPVVVTLKCDSA
ZmDGAT1-2(B73)    (151)    LPVFPLVALMAEKLITRKLIGEHVVILLHIIITTSAIVYPVVVTLKCDSA
      Consensus   (151)    LPVFPLVALMAEKLITRKLIGEHVVILLHIIITTSAIVYPVVVTLKCDSA
                         201                                                 250
ZmDGAT1-2(ASK)    (200)    VLSGFVLMFLASIMWMKLVSYAHTNYDIRVLSKSTEKGAAYGNYVDPENM
ZmDGAT1-2(EF09B)  (201)    VLSGFVLMFLASIMWMKLVSYAHTNYDIRVLSKSTEKGAAYGNYVDPENM
ZmDGAT1-2(Mo17)   (201)    VLSGFVLMFLASIMWMKLVSYAHTNYDIRVLSKSTEKGAAYGNYVDPENM
ZmDGAT1-2(B73)    (201)    VLSGFVLMFLASIMWMKLVSYAHTNYDIRVLSKSTEKGAAYGNYVDPENM
      Consensus   (201)    VLSGFVLMFLASIMWMKLVSYAHTNYDIRVLSKSTEKGAAYGNYVDPENM
                         251                                                 300
ZmDGAT1-2(ASK)    (250)    KDPTFKSLVYFMLAPTLCYQPTYPQTTCIRKGWVTQQLIKCVVFTGLMGF
ZmDGAT1-2(EF09B)  (251)    KDPTFKSLVYFMLAPTLCYQPTYPQTTCIRKGWVTQQLIKCVVFTGLMGF
ZmDGAT1-2(Mo17)   (251)    KDPTFKSLVYFMLAPTLCYQPTYPQTTCIRKGWVTQQLIKCVVFTGLMGF
ZmDGAT1-2(B73)    (251)    KDPTFKSLVYFMLAPTLCYQPTYPQTTCIRKGWVTQQLIKCVVFTGLMGF
      Consensus   (251)    KDPTFKSLVYFMLAPTLCYQPTYPQTTCIRKGWVTQQLIKCVVFTGLMGF
                         301                                                 350
```

FIGURE 30A

```
ZmDGAT1-2(ASK)   (300) IIEQYINPIVKNSKHPLKGNFLNAIERVLKLSVPTLYVWLCMFYCFFHLW
ZmDGAT1-2(EF09B) (301) IIEQYINPIVKNSKHPLKGNFLNAIERVLKLSVPTLYVWLCMFYCFFHLW
ZmDGAT1-2(Mo17)  (301) IIEQYINPIVKNSKHPLKGNFLNAIERVLKLSVPTLYVWLCMFYCFFHLW
ZmDGAT1-2(B73)   (301) IIEQYINPIVKNSKHPLKGNFLNAIERVLKLSVPTLYVWLCMFYCFFHLW
      Consensus  (301) IIEQYINPIVKNSKHPLKGNFLNAIERVLKLSVPTLYVWLCMFYCFFHLW
                       351                                              400
ZmDGAT1-2(ASK)   (350) LNIVAELLCFGDREFYKDWWNAKTVEEYWRMWNMPVHKWIIRHIYFPCIR
ZmDGAT1-2(EF09B) (351) LNIVAELLCFGDREFYKDWWNAKTVEEYWRMWNMPVHKWIIRHIYFPCIR
ZmDGAT1-2(Mo17)  (351) LNIVAELLCFGDREFYKDWWNAKTVEEYWRMWNMPVHKWIIRHIYFPCIR
ZmDGAT1-2(B73)   (351) LNIVAELLCFGDREFYKDWWNAKTVEEYWRMWNMPVHKWIIRHIYFPCIR
      Consensus  (351) LNIVAELLCFGDREFYKDWWNAKTVEEYWRMWNMPVHKWIIRHIYFPCIR
                       401                                              450
ZmDGAT1-2(ASK)   (400) KGFSRGVAILISFLVSAVFHEICIAVPCHIFKFWAFSGIMFQIPLVFLTR
ZmDGAT1-2(EF09B) (401) KGFSRGVAILISFLVSAVFHEICIAVPCHIFKFWAFSGIMFQIPLVFLTR
ZmDGAT1-2(Mo17)  (401) KGFSRGVAILISFLVSAVFHEICIAVPCHIFKFWAFSGIMFQIPLVFLTR
ZmDGAT1-2(B73)   (401) KGFSRGVAILISFLVSAVFHEICIAVPCHIFKFWAFSGIMFQIPLVFLTR
      Consensus  (401) KGFSRGVAILISFLVSAVFHEICIAVPCHIFKFWAFSGIMFQIPLVFLTR
                       451                                         495
ZmDGAT1-2(ASK)   (450) YLHATFKHVMVGNMIFWFFFSIVGQPMCVLLYYHDVMNRQAQASR
ZmDGAT1-2(EF09B) (451) YLHATFKHVMVGNMIFWFF-SIVGQPMCVLLYYHDVMNRQAQASR
ZmDGAT1-2(Mo17)  (451) YLHATFKHVMVGNMIFWFF-SIVGQPMCVLLYYHDVMNRQAQASR
ZmDGAT1-2(B73)   (451) YLHATFKHVMVGNMIFWFF-SIVGQPMCVLLYYHDVMNRQAQASR
      Consensus  (451) YLHATFKHVMVGNMIFWFF SIVGQPMCVLLYYHDVMNRQAQASR
```

FIGURE 30B

ZmDGAT1-2 ORF DNA alignments

```
                              1                                                  50
ZmDGAT1-2(ASK)      (1)   ATGGCCCCGCCCCCCTCCATGCCTGCCGCCTCCGATCGCGCCGGCCCTGG
ZmDGAT1-2(EF09B)    (1)   ATGGCCCCGCCCCCCTCCATGCCTGCCGCCTCCGATCGCGCCGGCCCTGG
ZmDGAT1-2(Mo17)     (1)   ATGGCCCCGCCCCCCTCCATGCCTGCCGCCTCCGATCGCGCCGGCCCTGG
ZmDGAT1-2(B73)      (1)   ATGGCCCCGCCCCCCTCCATGCCTGCCGCCTCCGATCGCGCCGGCCCTGG
       Consensus    (1)   ATGGCCCCGCCCCCCTCCATGCCTGCCGCCTCCGATCGCGCCGGCCCTGG
                              51                                                100
ZmDGAT1-2(ASK)     (51)   CCGCGACGCGGGCGACTCGTCCTCCCTTCGCCTCCGCCGCGCCCCCTCAG
ZmDGAT1-2(EF09B)   (51)   CCGCGACGCGGGCGACTCGTCCTCCCTTCGCCTCCGCCGCGCCCCCTCAG
ZmDGAT1-2(Mo17)    (51)   CCGCGACGCGGGCGACTCGTCCTCCCTTCGCCTCCGCCGCGCCCCCTCAG
ZmDGAT1-2(B73)     (51)   CCGCGACGCGGGCGACTCGTCCTCCCTTCGCCTCCGCCGCGCCCCCTCAG
       Consensus   (51)   CCGCGACGCGGGCGACTCGTCCTCCCTTCGCCTCCGCCGCGCCCCCTCAG
                              101                                               150
ZmDGAT1-2(ASK)    (101)   CCGACGCCGGCGACCTTGCCGGCGATTCCTCGGGAGGCTTGCGGGAGAAC
ZmDGAT1-2(EF09B)  (101)   CCGACGCCGGCGACCTTGCCGGCGATTCCTCGGTAGGCTTGCGGGAGAAC
ZmDGAT1-2(Mo17)   (101)   CCGACGCCGGCGACCTTGCCGGCGATTCCTCGGTAGGCTTGCGGGAGAAC
ZmDGAT1-2(B73)    (101)   CCGACGCCGGCGACCTTGCCGGCGATTCCTCGGTAGGCTTGCGGGAGAAC
       Consensus  (101)   CCGACGCCGGCGACCTTGCCGGCGATTCCTCGGTAGGCTTGCGGGAGAAC
                              151                                               200
ZmDGAT1-2(ASK)    (151)   GGCGAGCCGCAATCGCCGACGAATCCGCCGCCGCAGGAGCAGCAGCAG--
ZmDGAT1-2(EF09B)  (151)   GGCGAGCCGCAACCGCCGACGAATCCGCCGCCGCAGGAGCAGCAGCAGCA
ZmDGAT1-2(Mo17)   (151)   GGCGAGCCGCAACCGCCGACGAATCCGCCGCCGCAGGAGCAGCAGCAGCA
ZmDGAT1-2(B73)    (151)   GGCGAGCCGCAACCGCCGACGAATCCGCCGCCGCAGGAGCAGCAGCAGCA
       Consensus  (151)   GGCGAGCCGCAACCGCCGACGAATCCGCCGCCGCAGGAGCAGCAGCAGCA
                              201                                               250
ZmDGAT1-2(ASK)    (199)   -CACGAGATGCTATACTACCGCGCGTCGGCGCCCGCCCACCGCCGCGTCA
ZmDGAT1-2(EF09B)  (201)   GCACGAGATGCTATACTACCGCGCGTCGGCGCCCGCCCACCGCCGCGTCA
ZmDGAT1-2(Mo17)   (201)   GCACGAGATGCTATACTACCGCGCGTCGGCGCCCGCCCACCGCCGCGTCA
ZmDGAT1-2(B73)    (201)   GCACGAGATGCTATACTACCGCGCGTCGGCGCCCGCCCACCGCCGCGTCA
       Consensus  (201)   GCACGAGATGCTATACTACCGCGCGTCGGCGCCCGCCCACCGCCGCGTCA
                              251                                               300
ZmDGAT1-2(ASK)    (248)   AGGAGAGCCCCCTCAGCTCTGACGCCATCTTCCGGCAGAGCCATGCTGGT
ZmDGAT1-2(EF09B)  (251)   AGGAGAGCCCCCTCAGCTCTGACGCCATCTTCCGGCAGAGCCATGCTGGT
ZmDGAT1-2(Mo17)   (251)   AGGAGAGCCCCCTCAGCTCTGACGCCATCTTCCGGCAGAGCCATGCTGGT
ZmDGAT1-2(B73)    (251)   AGGAGAGCCCCCTCAGCTCTGACGCCATCTTCCGGCAGAGCCATGCTGGT
       Consensus  (251)   AGGAGAGCCCCCTCAGCTCTGACGCCATCTTCCGGCAGAGCCATGCTGGT
                              301                                               350
ZmDGAT1-2(ASK)    (298)   CTTCTGAATCTATGCATTGTTGTTCTGATCGCAGTGAACAGCAGACTCAT
ZmDGAT1-2(EF09B)  (301)   CTTCTGAATCTATGCATTGTTGTTCTGATCGCAGTGAACAGCAGACTCAT
ZmDGAT1-2(Mo17)   (301)   CTTCTGAATCTATGCATTGTTGTTCTGATCGCAGTGAACAGCAGACTCAT
ZmDGAT1-2(B73)    (301)   CTTCTGAATCTATGCATTGTTGTTCTGATCGCAGTGAACAGCAGACTCAT
       Consensus  (301)   CTTCTGAATCTATGCATTGTTGTTCTGATCGCAGTGAACAGCAGACTCAT
                              351                                               400
```

FIGURE 31A

```
ZmDGAT1-2(ASK)    (348) TATTGAGAATTTAATGAAGTATGGCCTGTTGATAAGAGCTGGATTTTGGT
ZmDGAT1-2(EF09B)  (351) TATTGAGAATTTAATGAAGTATGGCCTGTTGATAAGAGCTGGATTTTGGT
ZmDGAT1-2(Mo17)   (351) TATTGAGAATTTAATGAAGTATGGCCTGTTGATAAGAGCTGGATTTTGGT
ZmDGAT1-2(B73)    (351) TATTGAGAATTTAATGAAGTATGGCCTGTTGATAAGAGCTGGATTTTGGT
     Consensus    (351) TATTGAGAATTTAATGAAGTATGGCCTGTTGATAAGAGCTGGATTTTGGT
                        401                                              450
ZmDGAT1-2(ASK)    (398) TTAGTGCAAGATCGCTGGGTGACTGGCCCCTTCTAATGTGCTGCCTCACT
ZmDGAT1-2(EF09B)  (401) TTAGTGCAAGATCGCTGGGTGACTGGCCCCTTCTAATGTGCTGCCTCACT
ZmDGAT1-2(Mo17)   (401) TTAGTGCAAGATCGCTGGGTGACTGGCCCCTTCTAATGTGCTGCCTCACT
ZmDGAT1-2(B73)    (401) TTAGTGCAAGATCGCTGGGTGACTGGCCCCTTCTAATGTGCTGCCTCACT
     Consensus    (401) TTAGTGCAAGATCGCTGGGTGACTGGCCCCTTCTAATGTGCTGCCTCACT
                        451                                              500
ZmDGAT1-2(ASK)    (448) CTACCAGTTTTCCCACTAGTTGCACTCATGGCTGAGAAGCTGATCACAAG
ZmDGAT1-2(EF09B)  (451) CTACCAGTTTTCCCACTAGTTGCACTCATGGCTGAGAAGCTGATCACAAG
ZmDGAT1-2(Mo17)   (451) CTACCAGTTTTCCCACTAGTTGCACTCATGGCTGAGAAGCTGATCACAAG
ZmDGAT1-2(B73)    (451) CTACCAGTTTTCCCACTAGTTGCACTCATGGCTGAGAAGCTGATCACAAG
     Consensus    (451) CTACCAGTTTTCCCACTAGTTGCACTCATGGCTGAGAAGCTGATCACAAG
                        501                                              550
ZmDGAT1-2(ASK)    (498) AAAGCTCATTGGTGAACATGTGGTTATTCTACTCCATATCATTATTACAA
ZmDGAT1-2(EF09B)  (501) AAAGCTCATTGGTGAACATGTGGTTATTCTACTCCATATCATTATTACAA
ZmDGAT1-2(Mo17)   (501) AAAGCTCATTGGTGAACATGTGGTTATTCTACTCCATATCATTATTACAA
ZmDGAT1-2(B73)    (501) AAAGCTCATTGGTGAACATGTGGTTATTCTACTCCATATCATTATTACAA
     Consensus    (501) AAAGCTCATTGGTGAACATGTGGTTATTCTACTCCATATCATTATTACAA
                        551                                              600
ZmDGAT1-2(ASK)    (548) CATCTGCCATTGTCTATCCAGTTGTTGTGACTCTTAAGTGTGACTCAGCA
ZmDGAT1-2(EF09B)  (551) CATCTGCCATTGTCTATCCAGTTGTTGTGACTCTTAAGTGTGACTCAGCA
ZmDGAT1-2(Mo17)   (551) CATCTGCCATTGTCTATCCAGTTGTTGTGACTCTTAAGTGTGACTCAGCA
ZmDGAT1-2(B73)    (551) CATCTGCCATTGTCTATCCAGTTGTTGTGACTCTTAAGTGTGACTCAGCA
     Consensus    (551) CATCTGCCATTGTCTATCCAGTTGTTGTGACTCTTAAGTGTGACTCAGCA
                        601                                              650
ZmDGAT1-2(ASK)    (598) GTACTATCTGGATTTGTGCTAATGTTTCTTGCGAGCATCATGTGGATGAA
ZmDGAT1-2(EF09B)  (601) GTACTATCTGGATTTGTGCTAATGTTTCTTGCGAGCATCATGTGGATGAA
ZmDGAT1-2(Mo17)   (601) GTACTATCTGGATTTGTGCTAATGTTTCTTGCGAGCATCATGTGGATGAA
ZmDGAT1-2(B73)    (601) GTACTATCTGGATTTGTGCTAATGTTTCTTGCGAGCATCATGTGGATGAA
     Consensus    (601) GTACTATCTGGATTTGTGCTAATGTTTCTTGCGAGCATCATGTGGATGAA
                        651                                              700
ZmDGAT1-2(ASK)    (648) GCTTGTCTCTTATGCACATACAAATTATGATATAAGGGTATTGTCCAAAA
ZmDGAT1-2(EF09B)  (651) GCTTGTCTCTTATGCACATACAAATTATGATATAAGGGTATTGTCCAAAA
ZmDGAT1-2(Mo17)   (651) GCTTGTCTCTTATGCACATACAAATTATGATATAAGGGTATTGTCCAAAA
ZmDGAT1-2(B73)    (651) GCTTGTCTCTTATGCACATACAAATTATGATATAAGGGTATTGTCCAAAA
     Consensus    (651) GCTTGTCTCTTATGCACATACAAATTATGATATAAGGGTATTGTCCAAAA
                        701                                              750
```

FIGURE 31B

```
ZmDGAT1-2(ASK)    (698)  GTACTGAAAAGGGTGCTGCATATGGAAATTATGTCGATCCTGAGAATATG
ZmDGAT1-2(EF09B)  (701)  GTACTGAGAAGGGTGCTGCATATGGAAATTATGTCGATCCTGAGAATATG
ZmDGAT1-2(Mo17)   (701)  GTACTGAGAAGGGTGCTGCATATGGAAATTATGTCGATCCTGAGAATATG
ZmDGAT1-2(B73)    (701)  GTACTGAGAAGGGTGCTGCATATGGAAATTATGTCGATCCTGAGAATATG
      Consensus   (701)  GTACTGAGAAGGGTGCTGCATATGGAAATTATGTCGATCCTGAGAATATG
                         751                                              800
ZmDGAT1-2(ASK)    (748)  AAAGATCCAACCTTTAAAAGTCTAGTGTACTTTATGTTGGCCCCAACACT
ZmDGAT1-2(EF09B)  (751)  AAAGATCCAACCTTTAAAAGTCTAGTGTACTTCATGTTGGCCCCAACACT
ZmDGAT1-2(Mo17)   (751)  AAAGATCCAACCTTTAAAAGTCTAGTGTACTTCATGTTGGCCCCAACACT
ZmDGAT1-2(B73)    (751)  AAAGATCCAACCTTTAAAAGTCTAGTGTACTTCATGTTGGCCCCAACACT
      Consensus   (751)  AAAGATCCAACCTTTAAAAGTCTAGTGTACTTCATGTTGGCCCCAACACT
                         801                                              850
ZmDGAT1-2(ASK)    (798)  TTGTTACCAGCCAACTTATCCTCAAACTACATGTATTAGAAAGGGTTGGG
ZmDGAT1-2(EF09B)  (801)  TTGTTACCAGCCAACTTATCCTCAAACTACATGTATTAGAAAGGGTTGGG
ZmDGAT1-2(Mo17)   (801)  TTGTTACCAGCCAACTTATCCTCAAACTACATGTATTAGAAAGGGTTGGG
ZmDGAT1-2(B73)    (801)  TTGTTACCAGCCAACTTATCCTCAAACTACATGTATTAGAAAGGGTTGGG
      Consensus   (801)  TTGTTACCAGCCAACTTATCCTCAAACTACATGTATTAGAAAGGGTTGGG
                         851                                              900
ZmDGAT1-2(ASK)    (848)  TGACCCAGCAACTCATAAAGTGCGTGGTTTTTACAGGCTTGATGGGCTTC
ZmDGAT1-2(EF09B)  (851)  TGACCCAGCAACTCATAAAGTGCGTGGTTTTTACAGGCTTGATGGGCTTC
ZmDGAT1-2(Mo17)   (851)  TGACCCAGCAACTCATAAAGTGCGTGGTTTTTACAGGCTTGATGGGCTTC
ZmDGAT1-2(B73)    (851)  TGACCCAGCAACTCATAAAGTGCGTGGTTTTTACAGGCTTGATGGGCTTC
      Consensus   (851)  TGACCCAGCAACTCATAAAGTGCGTGGTTTTTACAGGCTTGATGGGCTTC
                         901                                              950
ZmDGAT1-2(ASK)    (898)  ATAATTGAGCAATATATAAACCCAATTGTGAAGAATTCCAAACATCCACT
ZmDGAT1-2(EF09B)  (901)  ATAATTGAGCAATATATAAACCCAATTGTGAAGAATTCCAAACATCCACT
ZmDGAT1-2(Mo17)   (901)  ATAATTGAGCAATATATAAACCCAATTGTGAAGAATTCCAAACATCCACT
ZmDGAT1-2(B73)    (901)  ATAATTGAGCAATATATAAACCCAATTGTGAAGAATTCCAAACATCCACT
      Consensus   (901)  ATAATTGAGCAATATATAAACCCAATTGTGAAGAATTCCAAACATCCACT
                         951                                             1000
ZmDGAT1-2(ASK)    (948)  GAAAGGGAATTTTTTGAATGCTATAGAAAGAGTCTTAAAACTCTCAGTGC
ZmDGAT1-2(EF09B)  (951)  GAAAGGGAATTTTTTGAATGCTATAGAAAGAGTCTTAAAACTCTCAGTGC
ZmDGAT1-2(Mo17)   (951)  GAAAGGGAATTTTTTGAATGCTATAGAAAGAGTCTTAAAACTCTCAGTGC
ZmDGAT1-2(B73)    (951)  GAAAGGGAATTTTTTGAATGCTATAGAAAGAGTCTTAAAACTCTCAGTGC
      Consensus   (951)  GAAAGGGAATTTTTTGAATGCTATAGAAAGAGTCTTAAAACTCTCAGTGC
                         1001                                            1050
ZmDGAT1-2(ASK)    (998)  CAACATTATATGTATGGCTTTGCATGTTCTATTGCTTTTTTCATTTATGG
ZmDGAT1-2(EF09B) (1001)  CAACATTATATGTATGGCTTTGCATGTTCTATTGCTTTTTTCATTTATGG
ZmDGAT1-2(Mo17)  (1001)  CAACATTATATGTATGGCTTTGCATGTTCTATTGCTTTTTTCATTTATGG
ZmDGAT1-2(B73)   (1001)  CAACATTATATGTATGGCTTTGCATGTTCTATTGCTTTTTTCATTTATGG
      Consensus  (1001)  CAACATTATATGTATGGCTTTGCATGTTCTATTGCTTTTTTCATTTATGG
                         1051                                            1100
```

FIGURE 31C

| | | |
|---|---|---|
| ZmDGAT1-2(ASK) | (1048) | CTGAACATTGTAGCTGAACTCCTCTGTTTCGGTGACCGTGAATTCTATAA |
| ZmDGAT1-2(EF09B) | (1051) | CTGAACATTGTAGCTGAACTCCTCTGTTTCGGTGACCGTGAATTCTATAA |
| ZmDGAT1-2(Mo17) | (1051) | CTGAACATTGTAGCTGAACTCCTCTGTTTCGGTGACCGTGAATTCTATAA |
| ZmDGAT1-2(B73) | (1051) | CTGAACATTGTAGCTGAACTCCTCTGTTTCGGTGACCGTGAATTCTATAA |
| Consensus | (1051) | CTGAACATTGTAGCTGAACTCCTCTGTTTCGGTGACCGTGAATTCTATAA |
| | | 1101                                        1150 |
| ZmDGAT1-2(ASK) | (1098) | GGACTGGTGGAATGCCAAAACTGTTGAAGAGTACTGGAGGATGTGGAACA |
| ZmDGAT1-2(EF09B) | (1101) | GGACTGGTGGAATGCCAAAACTGTTGAAGAGTACTGGAGGATGTGGAACA |
| ZmDGAT1-2(Mo17) | (1101) | GGACTGGTGGAATGCCAAAACTGTTGAAGAGTACTGGAGGATGTGGAACA |
| ZmDGAT1-2(B73) | (1101) | GGACTGGTGGAATGCCAAAACTGTTGAAGAGTACTGGAGGATGTGGAACA |
| Consensus | (1101) | GGACTGGTGGAATGCCAAAACTGTTGAAGAGTACTGGAGGATGTGGAACA |
| | | 1151                                        1200 |
| ZmDGAT1-2(ASK) | (1148) | TGCCTGTTCATAAGTGGATCATCAGACACATATATTTTCCATGTATAAGG |
| ZmDGAT1-2(EF09B) | (1151) | TGCCTGTTCATAAGTGGATCATCAGACACATATATTTTCCATGTATAAGG |
| ZmDGAT1-2(Mo17) | (1151) | TGCCTGTTCATAAGTGGATCATCAGACACATATATTTTCCATGTATAAGG |
| ZmDGAT1-2(B73) | (1151) | TGCCTGTTCATAAGTGGATCATCAGACACATATATTTTCCATGTATAAGG |
| Consensus | (1151) | TGCCTGTTCATAAGTGGATCATCAGACACATATATTTTCCATGTATAAGG |
| | | 1201                                      1250 |
| ZmDGAT1-2(ASK) | (1198) | AAAGGCTTTTCCAGGGGTGTAGCTATTCTAATCTCGTTTCTGGTTTCAGC |
| ZmDGAT1-2(EF09B) | (1201) | AAAGGCTTTTCCAGGGGTGTAGCTATTCTAATCTCGTTTCTGGTTTCAGC |
| ZmDGAT1-2(Mo17) | (1201) | AAAGGCTTTTCCAGGGGTGTAGCTATTCTAATCTCGTTTCTGGTTTCAGC |
| ZmDGAT1-2(B73) | (1201) | AAAGGCTTTTCCAGGGGTGTAGCTATTCTAATCTCGTTTCTGGTTTCAGC |
| Consensus | (1201) | AAAGGCTTTTCCAGGGGTGTAGCTATTCTAATCTCGTTTCTGGTTTCAGC |
| | | 1251                                      1300 |
| ZmDGAT1-2(ASK) | (1248) | TGTATTCATGAGATATGTATTGCGGTGCCTTGCCACATTTTCAAATTCT |
| ZmDGAT1-2(EF09B) | (1251) | TGTATTCCATGAGATATGTATTGCGGTGCCGTGCCACATTTTCAAATTCT |
| ZmDGAT1-2(Mo17) | (1251) | TGTATTCCATGAGATATGTATTGCGGTGCCGTGCCACATTTTCAAATTCT |
| ZmDGAT1-2(B73) | (1251) | TGTATTCCATGAGATATGTATTGCGGTGCCGTGCCACATTTTCAAATTCT |
| Consensus | (1251) | TGTATTCCATGAGATATGTATTGCGGTGCCGTGCCACATTTTCAAATTCT |
| | | 1301                                      1350 |
| ZmDGAT1-2(ASK) | (1298) | GGGCATTTTCTGGGATCATGTTTCAGATACCCTTGGTATTCTTGACAAGA |
| ZmDGAT1-2(EF09B) | (1301) | GGGCATTTTCTGGGATCATGTTTCAGATACCGTTGGTATTCTTGACAAGA |
| ZmDGAT1-2(Mo17) | (1301) | GGGCATTTTCTGGGATCATGTTTCAGATACCGTTGGTATTCTTGACAAGA |
| ZmDGAT1-2(B73) | (1301) | GGGCATTTTCTGGGATCATGTTTCAGATACCGTTGGTATTCTTGACAAGA |
| Consensus | (1301) | GGGCATTTTCTGGGATCATGTTTCAGATACCGTTGGTATTCTTGACAAGA |
| | | 1351                                      1400 |
| ZmDGAT1-2(ASK) | (1348) | TATCTCCATGCTACGTTCAAGCATGTAATGGTGGGCAACATGATATTTTG |
| ZmDGAT1-2(EF09B) | (1351) | TATCTCCATGCTACGTTCAAGCATGTAATGGTGGGCAACATGATATTTTG |
| ZmDGAT1-2(Mo17) | (1351) | TATCTCCATGCTACGTTCAAGCATGTAATGGTGGGCAACATGATATTTTG |
| ZmDGAT1-2(B73) | (1351) | TATCTCCATGCTACGTTCAAGCATGTAATGGTGGGCAACATGATATTTTG |
| Consensus | (1351) | TATCTCCATGCTACGTTCAAGCATGTAATGGTGGGCAACATGATATTTTG |
| | | 1401                                      1450 |

FIGURE 31D

```
ZmDGAT1-2(ASK)    (1398) GTTCTTCTTCAGTATAGTCGGACAGCCGATGTGTGTCCTTCTATACTACC
ZmDGAT1-2(EF09B)  (1401) GTTCTTC---AGTATAGTCGGACAGCCGATGTGTGTCCTTCTATACTACC
ZmDGAT1-2(Mo17)   (1401) GTTCTTC---AGTATAGTCGGACAGCCGATGTGTGTCCTTCTATACTACC
ZmDGAT1-2(B73)    (1401) GTTCTTC---AGTATAGTCGGACAGCCGATGTGTGTCCTTCTATACTACC
       Consensus  (1401) GTTCTTC   AGTATAGTCGGACAGCCGATGTGTGTCCTTCTATACTACC
                         1451                                           1488
ZmDGAT1-2(ASK)    (1448) ATGACGTCATGAACAGGCAGGCCCAGGCAAGTAGATAG
ZmDGAT1-2(EF09B)  (1448) ATGACGTCATGAACAGGCAGGCCCAGGCAAGTAGATAG
ZmDGAT1-2(Mo17)   (1448) ATGACGTCATGAACAGGCAGGCCCAGGCAAGTAGATAG
ZmDGAT1-2(B73)    (1448) ATGACGTCATGAACAGGCAGGCCCAGGCAAGTAGATAG
       Consensus  (1451) ATGACGTCATGAACAGGCAGGCCCAGGCAAGTAGATAG
```

FIGURE 31E

```
     ZmDGAT1-2 (ASK)         (1)  ------------------MAPPPS---------MPAASDRAGPGRD---------AGDSS
     ZmDGAT1-2 (EF09B)       (1)  ------------------MAPPPS---------MPAASDRAGPGRD---------AGDSS
     ZmDGAT1-2 (Mo17)        (1)  ------------------MAPPPS---------MPAASDRAGPGRD---------AGDSS
     ZmDGAT1-2 (B73)         (1)  ------------------MAPPPS---------MPAASDRAGPGRD---------AGDSS
    OsDGAT1-2 (BAD53762)     (1)  ------------------MAPPPS----------LAPDRGGGE-----------PDDAL
  TaDGAT1-2 (wr1.pk0119.b6]  (1)  MSKGNPDPHLPGSFLPSHGGPPPKPTPPRTFRNLPSSSTHGPA-----------PSVAA
            ZmDGAT1-1        (1)  ------------------MADSEDAPPAVHRRP---------PRPARG---AAAAQGFAA
       OsDGAT1 (AAV59457)    (1)  --------------MVGSDGDGDGGGPEAHAPAAPAHHHRRPPRPRGGS--GAIVEGFAA
  OsDGAT1-1 (rls24.pk0034.d8)(1)  --------------MVGSDGDGDGGGGEAHAGG---------PRRR---------AG
       GmDGAT (sr1.pk0098.a8)(1)  ---------------MAISDEPE-------SVATALNHSSLRRRPS--------AISTAG
       GmDGAT1 (AAS78622)    (1)  ---------------MAISDEFE-------TVATALNHSSLRRRP-----------TAAG
       LcDGAT1 (AAW51456)    (1)  ---------------MAISEDSESLFAAAAASSVIQSGSSVRRRP----------SAIS
       OeDGAT1 (AAS01606)    (1)  ---------------MTIPELPESLETITLNSHHSRAASTVRRR----SIDVAVLESDSN
       PfDGAT1 (AAG23696)    (1)  ---------------MAILDSPEILDTISSSADNCAAHHTTLRRRQSARSVPPLLDSDSN
        NtDGAT (AAF19345)    (1)  ---------------MVIMELPESVEMITTTTTSGIENLNSDLN-----HSVRRRR-GSN
       BjDGAT1 (AAY40784)    (1)  ---------------MAILDSGGVAVPPTENG--VADLDRLHRRKS-------RSDSSNG
       BjDGAT1 (AAY40785)    (1)  ---------------MAILDSG-TVTMATENG--VADLDMLRRRKS-------RSDSSNG
       AtDGAT1 (CAB45373)    (1)  ---------------MAILDSAGVITVIENGGGEFVDLDRLRRRKS-------RSDSSNG
       RcDGAT1 (AAR11479)    (1)  ---------------MTILETPETLGVISSSAT--SDLNLSLRRRR-------TSNDSDG
       ZmGPAT (p0036.cmtan26)(1)  ------------------------------------------------------------
        OsGPAT (Q7XBU3)      (1)  ------------------------------------------------------------
        EgGPAT (AAF64066)    (1)  ------------------------------------------------------------
        AtGPAT (BAA00575)    (1)  ------------------------------------------------------------
        PsGPAT (CAA41769)    (1)  ----------------------------------------------------------MT
        PvGPAT (CAA56159)    (1)  ---------------------------------------------------------MSMT
        OsLPAT (ABB47826)    (1)  ------------------------------------------------------------
       ZmLPAT (PCO519737)    (1)  ------------------------------------------------------------
        AtLLPAT (Q8CXU8)     (1)  ------------------------------------------------------------
        BnLPAT (Q9LLY4)      (1)  ------------------------------------------------------------
        CnLPAT (Q42670)      (1)  ------------------------------------------------------------
        SpDGAT2 (AAQ89590)   (1)  ------------------------------------------------------------
     OsDGAT2-1 (XP_467452)   (1)  ------------------------------------------------------------
     ZmDGAT2-2 (PCO521364)   (1)  ------------------------------------------------------------
       AtDGAT2 (NP_566952)   (1)  ------------------------------------------------------------
     OsDGAT2-2 (BAD33251)    (1)  ------------------------------------------------------------
     ZmDGAT2-1 (PCO521362)   (1)  ------------------------------------------------------------

ZmDGAT1-2 (ASK)        (25) SLRLRRAPSADAGDLAGDSSGGLRENGEPQSPTNPPPQEQQQ------------------
     ZmDGAT1-2 (EF09B)      (25) SLRLRRAPSADAGDLAGDSSVGLRENGEPQPPTNPPPQEQQQQ-----------------
     ZmDGAT1-2 (Mo17)       (25) SLRLRRAPSADAGDLAGDSSVGLRENGEPQPPTNPPPQEQQQQ-----------------
     ZmDGAT1-2 (B73)        (25) SLRLRRAPSADAGDLAGDSSVGLRENGEPQPPTNPPPQEQQQ------------------
    OsDGAT1-2 (BAD53762)    (21) RLRARAAAAAGDAPADQQQQEQRH------------QEQQQQ------------------
  TaDGAT1-2 (wr1.pk0119.b6] (50) ATIATTPPSASAAPLPPTVHGEAAHGA----------AAAARR-----------------
            ZmDGAT1-1       (31) ALRRRLRSGAAVAARASFAADSGDESGPGEPSSSRRR--------DNSGG----ASSAAG
       OsDGAT1 (AAV59457)   (45) ALRRRIRSGAAAAARASFGGDSGDEAASGEPSSSSSSSPSRRRGGDSNGAEASSAAGGGG
  OsDGAT1-1 (rls24.pk0034.d8)(26) QLRGRLR---------------DEAAPGSPPRPRPR-P-RPRGGDSNGRSVLRPGGGGG
       GmDGAT (sr1.pk0098.a8)(31) LFNSPETTTDSSGDDLAKDSGS--DDSINSDDAAVNSQQQNE---------------KQD
       GmDGAT1 (AAS78622)   (28) LFNSPETTTDSSGDDLAKDSGS--DDSISSDAANSQPQQ----------------KQD
       LcDGAT1 (AAW51456)   (35) AVATVEDESSSEEPVPVRDSGSDVDDSVSSEQHVSPATANREK------------NQV
       OeDGAT1 (AAS01606)   (42) SLEAV---NDSDSDVNNTNEMGNLRGGVVESALEEPSELGTEGLRNGKEENEHVRIGESN
       PfDGAT1 (AAG23696)   (46) SLEAESAINDSEAVRNDANLIENLRGGAVESENEKQESYGKE---EGAKVKENGETSNGN
        NtDGAT (AAF19345)   (40) GFEAASAINSSDANMSEDRRDVCGSGAGLETVNERSKSVGESSDVIRKEDDRNDNVANGE
       BjDGAT1 (AAY40784)   (37) LLS----DTSPSDDVCAAAAERDRVDSAAEEEAQGTANLAGC------DAETRESAGC--
       BjDGAT1 (AAY40785)   (36) LLS----ETSPSDDAGAPADVEDRVDS-A---AQGTANLAG-------DIETRESGGGGG
       AtDGAT1 (CAB45373)   (39) LLLSGSDNNSPSDDVGAPADVRDRIDSVVNDDAQGTANLAGDNNGGG-DNNGGGRGGGEG
       RcDGAT1 (AAR11479)   (37) ALADLASKFDDDDDVRSEDSAENIIEDPVAAVTELATAKSNGKDCVANSNKDKIDSHGG-
       ZmGPAT (p0036.cmtan26)(1) ------------------------------------------------------------
        OsGPAT (Q7XBU3)     (1) ------------------------MQAPPLASSPSPAW---------------------
        EgGPAT (AAF64066)   (1) MLVPSALPRVSRSVSAARFSVSGVGSSPALSSRSCTSLDSSVR-----------------
        AtGPAT (BAA00575)   (1) -----MTLTFSSSAATVAVAAATVTSSARVPVYPIASSTLRGL-----------------
        PsGPAT (CAA41769)   (3) DSFAHCASHIN---YRHKMKTMFIFSTPCCSPSTAFFSP--------------------
        PvGPAT (CAA56159)   (5) GSSAYYVAHAIPPFLRLSNKTMLLLSTPPTTFFPTSTTPRVTL-----------------
        OsLPAT (ABB47826)   (1) -------------------MGTLLRPRPLAHAAGAGD----------------------
       ZmLPAT (PCO519737)   (1) -------------------MGTLIRPGPAASPLPIAS----------------------
        AtLLPAT (Q8CXU8)    (1) -------------------MDVASARSISSHPSYYGKPICS-------------------
        BnLPAT (Q9LLY4)     (1) -------------------MDVASARGVSSHPPYYSKPICS-------------------
        CnLPAT (Q42670)     (1) ------------------------------------------------------------
        SpDGAT2 (AAQ89590)  (1) -------------------MAMGEERE--------------------------------
     OsDGAT2-1 (XP_467452)  (1) -------------------MGAGNGEVRYG--GGGAGAGEA-------------------
     ZmDGAT2-2 (PCO521364)  (1) -------------------MGADCGLNRAAEKPRDG------------------------
       AtDGAT2 (NP_566952)  (1) ------------------------------------------------------------
     OsDGAT2-2 (BAD33251)   (1) -------------------MGANGNDVVAAAAAGESPMGAA-------------------
     ZmDGAT2-1 (PCO521362)  (1) -------------------MGAGTN-------NGLSNGAAA-------------------
```

FIGURE 33A

```
                                    1
ZmDGAT1-2(ASK)         (67)  ----------HEMLYYRASAPAHRRVKESPLSSEAIFRQSHAGLLNLCIVVLIAVNSRLI
ZmDGAT1-2(EFC9B)       (68)  ----------HEMLYYRASAPAHRRVKESPLSSEAIFRQSHAGLLNLCIVVLIAVNSRLI
ZmDGAT1-2(Mo17)        (68)  ----------HEMLYYRASAPAHRRVKESPLSSEAIFRQSHAGLLNLCIVVLIAVNSRLI
ZmDGAT1-2(B73)         (68)  ----------HEMLYYRASAPAHRRVKESPLSSEAIFRQSHAGLLNLCIVVLIAVNSRLI
OsDGAT1-2(BAD53762)    (51)  ------------LLWYRASAPAHRRVRESPLSSEAIFRQSHAGLLNLCIVVLVAVNSRLI
TaDGAT1-2(wr1.pk0119.b6)(83) ------------DALLPGVGAAHRVKESPLSSEAIFRQSHAGLLNLCIVVLIAVNSRLI
ZmDGAT1-1              (79)  G---RAGAGDFSAFTFRAAAFVHRKAKESPLSSEAIFKQSHAGLFNLCIVVLVAVNSRLI
OsDGAT1(AAV59457)      (105) G---RGGGGDFSAFTFRAAAEVHRKAKESPLSSEAIFKQ--------------------
OsDGAT1-1(rls24.pk0034.d8)(68) ----RGGGGDFSAFTFRAAAPVHRKAKESPLSSEAIFKQSHAGLFNLCIVVLVAVNSRLI
GmDGAT(sr1.pk0098.a8)  (74)  T------DFSVLKFAYRPSVPAHRKVKESPLSSEYIFRQSHAGLFNLCIVVLVAVNSRLI
GmDGAT1(AAS78622)      (68)  T------DFSVLKFAYRPSVPAHRKVKESPLSSELIFRQSHAGLFNLCIVVLVAVNSRLI
LcDGAT1(AAW51456)      (81)  H------DISATKFAYRPSVPAHRKVKESPLSSENIFRH-HAGLFNLCIVVLVAVNSRLI
OeDGAT1(AAS01606)      (99)  QEM---EVLASAKFAHRPSAFVHRRIKESPLSSEAIFKQSHAGLFNLCIVVLVAVNSRLI
PfDGAT1(AAG23696)      (103) G-----TDVMAVKFTFRPAAPAHRKNKESPLSSEAIFKQSHAGLFNLCIVVLVAVNSRLI
NtDGAT(AAF19345)       (100) ESKSTETTTTPFKFAYRASAPAHRRIKESPLSSEAIFRQSHAGLFNLCVVVLIAVNSRLI
BjDGAT1(AAY40784)      (85)  ----------DVRFTYRPSVPAHRRTRESPLSSEAIFKQSHAGLFNLCVVVLVAVNSRPI
BjDGAT1(AAY40785)      (81)  G------GNGEVRFTYRPSVPAHRRTRESPLSSEAIFKQSHAGLFNLCVVVLVAVNSRLI
AtDGAT1(CAB45373)      (98)  R------GNADATFTYRPSVPAHRRARESPLSSEAIFKQSHAGLFNLCVVVLIAVNSRLI
RcDGAT1(AAR11479)      (96)  --------SSDFKLAYRPSVPAHRSLKESPLSSILIFKQSHAGLFNLCIVVLVAVNSRLI
ZmGPAT(p0036.cmtar26)  (1)   ------------------------------------------------------------
OsGPAT(Q7XBU3)         (15)  ----------TAILPAPARLCCSRR--------GALRLEAKAAWRPAARGPRVPAKGAVL
EgGPAI(AAF64066)       (44)  ----------SSLRRCPCGHYTSRFKA----VVEAVESFASAREWRSAVKRAVLASDTGA
AtGPAI(BAA00575)       (39)  ----------VSFRLTAKELFLPPLRSKGGVSVRAMSELVQDKESSVAASIAFNEAAGET
PsGPAI(CAA41769)       (40)  ----------RASNSKPLRSTLSLRSSSIS---SSSITSTSHCSLAFNIVKHKEKNVVSAN
PvGPAI(CAA56159)       (48)  ----------LSSTSSSSSSSISLRSSSTAP--SPSCSSVIPKDNCLASAKHSPP-----N
OsLPAI(ABB47826)       (19)  ----------ATPSTAMAVVSGGRGR--GVRCQPIIRVPRKPGPQ------VAVATASWR
ZmLPAT(PCO519737)      (19)  ----------PSSSSAHVAVVGGGARS--LRHRVSVSVAVPRSPS------TQVLAFRWR
AtLLDAT(Q8CXU8)        (23)  ----------SQSSLIRISRDKVCCFGKLSNCMESFTTSLRAVPSEKFVCETRRTCIQWS
BnLPAT(Q9LLY4)         (23)  ----------SQSSLIRIPLBKGGCFAPSSNLTTSLRAASRGVTR-------RTSEVQWC
CnLPAT(Q42670)         (1)   ----------MDASGASSFLRGRCLESCFKASFGMSQPKDAAGQ----------------
SpDGAT2(AAQ89590)      (9)   ------------PAPETVVVKANGRS-AIRSLVATMLWVCPIALT----------------
OsDGAT2-1(XP_467452)   (21)  ----------AVMADDGTIVFRGTAQP-PVRTTVALALWLGAIHFN---------------
ZmDGAT2-2(PCO521364)   (18)  ----------EGGSAVRVFRCTDYS-LPRTTLALALWLGGIHFN---------------
AtDGAT2(NP_566952)     (1)   ----------MGGSREFRAEEISNQFIISIEAMAIWLGAIHFN---------------
OsDGAT2-2(BAD33251)    (23)  ----------RVVAEGGAIVFRGADYS-LPRTTVALALWLGGIHFN---------------
ZmDGAT2-1(PCO521362)   (16)  ----------GCRADDGTIVFRGTAYS-FLRTTVALALWLGALHFN---------------

2
ZmDGAT1-2(ASK)         (117) IENLMKYGLLIRAGFWFSARSLGDWPLLMCCLTLPVFPLVALMAEKLIIRKLIGEHVVIL
ZmDGAT1-2(EFC9B)       (118) IENLMKYGLLIRAGFWFSARSLGDWPLLMCCLTLPVFPLVALMAEKLIIRKLIGEHVVIL
ZmDGAT1-2(Mo17)        (118) IENLMKYGLLIRAGFWFSARSLGDWPLLMCCLTLPVFPLVALMAEKLIIRKLIGEHVVIL
ZmDGAT1-2(B73)         (118) IENLMKYGLLIRAGFWFSARSLGDWPLLMCCLTLPVFPLVALMAEKLIIRKLIGEHVVIL
OsDGAT1-2(BAD53762)    (99)  IENLMKYGLLIRAGFWFSGTSLEDWPLMCCLTLPTFPLAALMVEKLAQRKLISKHVVIL
TaDGAT1-2(wr1.pk0119.b6)(131) IENLMKYGLLIRAGFWFSARSLGDWPLLMCCLTLPIFPLAALMTEKWAQRKLIRDHVSIL
ZmDGAT1-1              (136) IENLMKYGLLIRSGFWFNACSLRDWPLMMCCLSLPFFPLGAFAVEKLAFNNLVSDPATPC
OsDGAT1(AAV59457)      (141) ------YGLLIRAGFWFNDKSLRDWPLLMCCLSLPAFPLGAFAVEKLAFNNVITDAVATC
OsDGAT1-1(rls24.pk0034.d8)(124) IENLMKYGLLIRAGFWFNDKSLRDWPLLMCCLSLPAFPLGAFAVEKLAFNNVITDAVATC
GmDGAT(sr1.pk0098.a8)  (128) IENLMKYGWLIKSGFWSSKSLRDWPLHMCCLSLVVFPAAFIVEKLAQRKCIPEPVVVV
GmDGAT1(AAS78622)      (122) IENLMKYGWLIKSGFWSSKSLRDWPLLMCCLSLVVFPAAFIVEKLAQQKCIPEDVVVV
LcDGAT1(AAW51456)      (134) IENLMKYGWLIRAGFWSSKSLRDWPLSLAIPPFAAFVVEKLVQQKCISEP-VVV
OeDGAT1(AAS01606)      (156) IENLMKYGWLINSGFWSSTSLRDWPLLMCCLSLPIFPLAAFSVEKLVLLKYISECVAVF
PfDGAT1(AAG23696)      (158) IENLMKYGWLIKSGFWSSTSLRDWPLLMCCLSLPVFALASFLVEKLVKLNYIPEWVAVF
NtDGAT(AAF19345)       (160) IENLMKYGLLIRAGFWFSSKSLRDWPILMCCLSLQTLFPLAAFLVEKTAQQRHLTERAVVT
BjDGAT1(AAY40784)      (135) IENLMKYGWLIRTCFWFSSTSLKDWPLLMCCLSLVFPLAAFLVEKMVLQKFISEPVAII
BjDGAT1(AAY40785)      (135) IENLMKYGWLIRTCFWFSSTSLKDWPLLMCCLSLSIFPLAAFLVEKLVLQKFISEPVVII
AtDGAT1(CAB45373)      (152) IENLMKYGWLIRDDFWFSSRSLRDWPLFMCCLSLSIFPLAAFLVEKLVLQKYISEDVVIF
RcDGAT1(AAR11479)      (148) IENLMKYGWLIKTGFWSSRSLEDWPLMMCCLSLPVFPLAAYLVEKAAYRKYISPPIVIF
ZmGPAT(p0036.cmtar26)  (1)   ------------------------------------------------------------
OsGPAT(Q7XBU3)         (57)  ASEVVGPSLLDARNEQELILHIRKEVEKGKLPADVAANLEELYYNYKDAVMQSRDPNAH
EgGPAI(AAF64066)       (90)  EEFVGHSRSPLRARSEEELLSYIEKEVFTGRLSSDIANGLEFLYYNYRNAVIQSGDPRAN
AtGPAI(BAA00575)       (89)  PSELNHSRTFLDARSEQDLLSGIKKEAEAGRLFANVAAGMEELYWNYKNAVLSSGASRAD
PsGPAI(CAA41769)       (87)  MTSSVSSRTFLNAQNEQDVLSGIKKEVEAGTLPASIAAGMEEVYLNYKSAVIKSGDPKAN
PvGPAI(CAA56159)       (91)  MSASVSSRTFLNAQSEQDVFAGIKKEAEAGSLEANVAAGMEEVYNNYKKAVIQSGDPKAN
OsLPAI(ABB47826)       (61)  RR------------RE----TVVRSDFAAG-----GAATMGDSPQALSDIEVVSRVRGVC
ZmLPAT(PCO519737)      (61)  RK------------RG----MVVESDVVAGGA---AAAAGDSTFALPGQQLASRVRGVC
AtLLDAT(Q8CXU8)        (73)  NPSLREDPYRFLPKKSPRSSQLARDITVRADL---SGAATPDSSFPEPEIKLSSRLRGIF
BnLPAT(Q9LLY4)         (66)  YRSIRFDPFKVNDKNS-------RTVTVRSDL---SGAATPESTYPEPEIKLSSRLRGIC
CnLPAT(Q42670)         (35)  ------------------P------SRRPADADFVDDDRWITVILSVV
SpDGAT2(AAQ89590)      (41)  ----------------AFLCLVALYCR-STASLWIIGFLLLLVFVPVSDKSYGRAI
OsDGAT2-1(XP_467452)   (56)  ----------------AFLLLASLFLFPRRVAAMVLATQLFFMFAPVNDMSRLGRKI
ZmDGAT2-2(PCO521364)   (50)  ----------------VLLVLASLFLLSCRAAAIVVAFQLLLMFAPVNDRDKWCQSV
AtDGAT2(NP_566952)     (33)  ----------------VALVLCSLIFLPPSLSLMVLGLLSLFIFIPICHRSKYGRKL
OsDGAT2-2(BAD33251)    (58)  ----------------VFLVLASLFLFPRLRVAAMVVAFQLLFMLIPLNDKDKLGRKI
ZmDGAT2-1(PCO521362)   (51)  ----------------AFLVLASLFLFPRRVAALVLATQLFFMFLPLSDKSRLGRKI
```

```
                                    14                              15
     ZmDGAT1-2(ASK)   (412) FLVSAVFHEIC AVPC HIFKFWAF SCIMFQIPLV LTRYLHATFKHV MVGNA IFWFFFSI
    ZmDGAT1-2(EF09B)  (413) FLVSAVFHEIC AVPC HIFKFWAF SGIMFQIPLV LTRYLHATFKHV MVGNA IFWFF-SI
    ZmDGAT1-2(Mo17)   (413) FLVSAVFHEIC AVPC HIFKFWAF SGIMFQIPLV LTRYLHATFKHV MVGNA IFWFF-SI
    ZmDGAT1-2(B73)    (413) FLVSAVFHEIC AVPC HIFKFWAF SGIMFQIPLV LTRYLHATFKHV MVGNA IFWFF-SI
   OsDGAT1-2(BAD53762)(394) YFIVLIDLQLC AVPC HIFKWAF IGIMFQIPLV LTKYLQDKFNNT MVGNA IFWFFFSI
 TaDGAT1-2(wr1.pk0119.b6](426) FLVSAVFHELC AVPC HIFKLWAF GGIMFQIPLL LTKYLQDKFNT MVGNA IFWFFFSI
      ZmDGAT1-1       (431) FFVSAVLHELC AVPC HILKPWAF LGIMLQIPLI ILTSYLNKFSDT MVGNA IFWFFFCI
   OsDGAT1(AAV59457)  (423) FLVSAVLHEIC AVPC RILKFWAFL GIMLQIPLI VLTAYLKSKFRDT MVGNA IFWFFFCI
 OsDGAT1-1(r1s24.pk0034.d8)(419) FLVSAVLHEIC AVPC RILKPWAFL GIMLQIPLI VLTAYLKSKFRDT MVGNA IFWFFFCI
   GmDGAT(sr1.pk0098.a8)(423) FLVSALFHELC AVPC HIFKLWAF GGIMFQVPLV FITNYLQNKFRNS MVGNA IFWFIFSI
   GmDGAT1(AAS78622)  (417) FLVSALFHELC AVPC HIFKLWAF GGIMFQVPLV FITNYLQNKFRNS MVGNA IPWFIFSI
   LcDGAT1(AAW51456)  (428) FLVSALFHELC AVPC HIFKLWAF GGIMFQVPLL LITNYLQNKFRNS MVGNA IFWFIFSI
   OeDGAT1(AAS01606)  (451) PLISAIFHELC AVPC HIFKFWAF IGIMFQVPLV ILTNYLQDKFQNS MVGNA IPWCFFSI
   PfDGAT1(AAG23696)  (453) FLVSAVFHELC AVPC QIFKFWAFS GIMLQVPLV IVINYLQEKFKNS MVGNA MFWCFFCI
    NtDGAT(AAF19345)  (451) FLVSAVFHELC AVPC RLFKWWAF MGIMFQVPLV IILTNFLQNKFQSS MVGNA MFWCFFCI
   BjDGAT1(AAY40784)  (423) FLVSAVFHELC AVPC RLFNLWAF MGIMFQVPLV FITNFLQERFG-S MVGNA IFWFSFCI
   BjDGAT1(AAY40785)  (423) FLVSAVFHELC AVPC RLFNLWAF IGIMFQVPLV FITNYLQERFG-S MVGNA IFWFSFCI
   AtDGAT1(CAB45373)  (440) FLVSAVFHELC AVPC HIFKLWAF IGIMFQVPLV FITNYLQERFG-S MVGNA IFWFIFCI
   RcDGAT1(AAR11479)  (442) FFVSAVFHELC AVPC HMFKLWAFF GIMFQIPLV VITNYFQRKFRSS MVGNA IFWFFFCI
   ZnGPAT(p0036.cmtan26)(164) RVISFHGAGLS VTEEINYGD ITAHTKNADE GRELFTNTLY NSVVNQYNVLF SAIFRDRGA
   OsGPAT(Q7XBU3)     (354) RVISFHGVGLS VTEEIKYSD ITVHTQNVDE CREKFSESLY NSVVDQYNALK SAIFRGRGA
   EgGPAT(AAF64066)   (387) RTISFHGVGLS VAPELNFNE LTAGCETPEE AKEAFSQALY NSVGEQYNVLF SAIHEERGL
   AtGPAT(BAA00575)   (386) RLVCFHGTGLS IAPEINFSD VTADCESPNE AKEAYSQALY KSVNEQYEILN SAIKHRRGV
   PsGPAT(CAA41769)   (384) RIISYHGTGIS TAPEISFSN TTAACENPEK AKDAYTKALY DSVTEQYDVLK SATHGKKGL
   PvGPAT(CAA56159)   (388) RIICFHGAGIS VAPAISFSE TTATCENPEK AKEVFSKALY NSVTEQYNVLF SAIQGKKGP
   OsLPAT(ABB47826)   (289) GILNSGSVKLI IHHPIEGND AEKICS---S ARKVIADTLI LNGYGVH---------
   ZmLPAT(PCO519737)  (291) GILNSGSVKV IIHRPIQGNE AETICS---S ARNVIADTLL LHGYGAH---------
   AtLLPAT(Q8GXU8)    (319) GILNHGNVAV IIHKPIHGSK ADVLCN----S ARSKIAESMDL--------------
   BnLPAT(Q9LLY4)     (305) GILNHGDVPV IIHKPIYGSK ADVICE----S ARNKIAESMNLLS-------------
   CnLPAT(Q42670)     (256) TVKYFSPIKTDDWEEEKINH YVEMIHALYVDHLPESQKPLVSKGRDASGRENS-------
   SpDGAT2(AAQ89590)  (270) DVVVGKPMEVK QNPNPSAEE VAELHAQELS NVETLFSKYR ESTGNAGAELP IL-----
   OsDGAT2-1(XP_467452)(286) EVVVGRPIEVK KNAQFTFDE INEVVALQEL FEKYKTKAGY PNLELRVL-------
   ZmDGAT2-2(PCO521364)(280) EVVVGKPIEVN KIPHPTIDE INEVHEQE I AMRDLSEKYK AKAGYPGLEL RVL-----
   AtDGAT2(NP_566952) (263) EVVVGKPIEVT KPLKPTDEE IAKFHGQYVE ALRDLLERHK SRVGY-DLEL KIL-----
   OsDGAT2-2(BAD33251)(288) EVVVGRPIEVE KNSQPTIDE INEVHEQETV ALQDLSDKYK TETGYPGLEL RVL-----
   ZmDGAT2-1(PCO521362)(281) EVIVGRPIEVN KPQFTIDE INQVHGQFVV AMQDLFEKYK SRTGYPDLQL RVL-----

16       17      18
     ZmDGAT1-2(ASK)   (472) VGQPM CVLLYYH VMNR CAQA SR-
    ZmDGAT1-2(EF09B)  (472) VGQPM CVLLYYH VMNR CAQA SR-
    ZmDGAT1-2(Mo17)   (472) VGQPM CVLLYYH VMNR CAQA SR-
    ZmDGAT1-2(B73)    (472) VGQPM CVLLYYH VMNR CAQA SR-
   OsDGAT1-2(BAD53762)(454) LGQPM CVLLYYH VMNR DCAQ NR-
 TaDGAT1-2(wr1.pk0119.b6](486) VGQPM CVLLYYH VMNR CAQA NG-
      ZmDGAT1-1       (491) LGQPM CVLLYYH VMNR TEKAK---
   OsDGAT1(AAV59457)  (483) LGQPM CLLLYYH VMNR IEKAR---
 OsDGAT1-1(r1s24.pk0034.d8)(479) LGQPM CLLLYYH VMNR IEKAR---
   GmDGAT(sr1.pk0098.a8)(483) LGQPM CVLLYYH LMNR KGKLD--
   GmDGAT1(AAS78622)  (477) LGQPM CVLLYYH LMNR KGKLD--
   LcDGAT1(AAW51456)  (488) LGQPM AVLLYYH LMNR KSKLDQS
   OeDGAT1(AAS01606)  (511) LGQPM CLLLYYH LMNR KASAK--
   PfDGAT1(AAG23696)  (513) LGQPM CVLLYYH LMNR KASAR--
    NtDGAT(AAF19345)  (511) LGQPM CVLLYYH VMNR KSSAR--
   BjDGAT1(AAY40784)  (482) LGQPM CVLLYYH LMNR KGSMS--
   BjDGAT1(AAY40785)  (482) LGQPM CVLLYYH LMNR KGSMS--
   AtDGAT1(CAB45373)  (499) LGQPM CVLLYYH LMNR KGSMS--
   RcDGAT1(AAR11479)  (502) LGQPM CVLLYYH LMNR DGN----
   ZnGPAT(p0036.cmtan26)(224) AVGNNVISLSQPWR-----------
   OsGPAT(Q7XBU3)     (414) DSEDSAISLSQPWR-----------
   EgGPAT(AAF64066)   (447) NAENSIISLSQPWQ-----------
   AtGPAT(BAA00575)   (446) EASTSRVSLSQPWN-----------
   PsGPAT(CAA41769)   (444) QASTPVVSLSQPWK-----------
   PvGPAT(CAA56159)   (448) EASTPVVTLSQPWK-----------
   OsLPAT(ABB47826)   (333) -------------------------
   ZmLPAT(PCO519737)  (335) -------------------------
   AtLLPAT(Q8GXU8)    (357) -------------------------
   BnLPAT(Q9LLY4)     (345) -------------------------
   CnLPAT(Q42670)     (309) -------------------------
   SpDGAT2(AAQ89590)  (323) -------------------------
   OsDGAT2-1(XP_467452)(339) -------------------------
   ZmDGAT2-2(PCO521364)(333) -------------------------
   AtDGAT2(NP_566952) (315) -------------------------
   OsDGAT2-2(BAD33251)(341) -------------------------
   ZmDGAT2-1(PCO521362)(334) -------------------------
```

FIGURE 33E

>ZmAAP1 protein and top 10 hits alignment

```
ZmAAP1(Mo17)      (1)  ----------------MDVDMQARGGGGSHGG I D  KEK   TVW AS
ZmAAP2            (1)  --------MVGAMRGGAMELEDRLAT PRFRG H D  KER   TVW AT
OsAAP(BAD53557)   (1)  --------------------MDVY PRTQGDV D  KER   TVW AT
OsAAP(BAD53554)   (1)  MAKDVEMAVRNGDGGGGGGYYATHPHGGAGGE D  KQR   NVW AS
OsAAP(BAD37473)   (1)  --MASVDLELGRPLSAAAAAYPPPLRRSINDD V D  KPK   TEW AS
RcAAP(CAA07563)   (1)  ---MVENTAAKNHPHQVFDVSINMQTQVVGSKW  D  RTK   TVW AS
AtAAP(AAM91305)   (1)  ------------MVQNHQTVLAVDMPQTGGSKY  D  KNK   SVW AS
AtAAP1(BAB83868)  (1)  -----MKSFNTEGHNHSTAESGDAYT SDPTKNV E  REK   TWL AS
BnAAP(CAD92449)   (1)  -----MKSFNTDQHGHSAAESGDVYA SDPTKNV D  REK   TWL AS
AtAAP6(BAA97227)  (1)  ---------MEKKKSMFVEQSFPEHE GDTNKNF E  R K   TWM GS

ZmAAP1(Mo17)     (35)       I  I         AM       VA P I L   AAI YY SCL TD
ZmAAP2           (43)       I  I         AM       VA P TLVL  AAI FY CGL AD
OsAAP(BAD53557)  (29)       I   I        AM       VA P TL L  AAI FY CGL SD
OsAAP(BAD53554)  (51)       I   I        AT       VV P TLML  ALI YY SGL AD
OsAAP(BAD37473)  (49)       IV  V        ST       VA PATL VV AVI YY SVL AD
RcAAP(CAA07563)  (48)       II  I        AI       IA PAVMFL SLV YY STL SA
AtAAP(AAM91305)  (39)       II  I        AT       LA P VM L SAV YF SSL AA
AtAAP1(BAB83868) (46)       I   I        AI       IA TS L I SFI YF STM AD
BnAAP(CAD92449)  (46)       I   I        AI       IA  LIL I SFI YF STM AD
AtAAP6(BAA97227) (42)       I   I        AI       VA PA LMA SFI YF STM AD

ZmAAP1(Mo17)     (85)  FG- PAT       TEA ESY  RY WF  FC  A MF TG I   TAS
ZmAAP2           (93)  VG- PVT       TEA KSN  WY WF  FC  V MF TG I   TAS
OsAAP(BAD53557)  (79)  VG- PAT       TDA KSY  WH WF  FC  V MF TG I   TAS
OsAAP(BAD53554) (101)  TG- PVS       MDA AAY  WQ WS  VF  V LV TAI    TAS
OsAAP(BAD37473) (99)   AGG QVS       MDA ESY  RQ WF  C   V LV TAI    TAS
RcAAP(CAA07563) (98)   SG- PV        MDA R N  AK KL  FV  L LF VAI    ASS
AtAAP(AAM91305) (89)   SG- PIS       MDA RSN  VK TL  IV  L IF VAI    ASA
AtAAP1(BAB83868) (96)  AP- PVT       MDV RSY  RK QL  VA G LI VT     TAS
BnAAP(CAD92449) (96)   AP- P T       MDV RSY  RK QL  VA G LI IT     TAS
AtAAP6(BAA97227) (92)  SP- PVT       ME V RSY  RK QL  A  G LI ITI    TAS

ZmAAP1(Mo17)    (134)  A AA ILKS   F WH HDAD  TQNT GSYI G GVVQ IFSQ SNFHELWW
ZmAAP2          (142)  I AA INKS   F WH HDAD  SQNT SAYI IG GVVQ IFSQ HNFHKLWW
OsAAP(BAD53557) (128)  I AA INKS   Y WR HGTD  SQNT SAYI IG GVLQA FCQ PNFHQLWW
OsAAP(BAD53554) (150)  I AA VHKA   Y KN HDAD  GVYDTTYMIV GVVQI FSM PNFSDLSW
OsAAP(BAD37473) (149)  I AA VYKSN  F KN HSAD  SVFT SYM V GVVQ FFSQ QSLHE AW
RcAAP(CAA07563) (147)  I MM IKRS   F KS GKNP  H NANPYMIA G AEI IFSQ PDFDQLWW
AtAAP(AAM91305) (138)  I MM IKRS   F KS GKDP  H MN PYMIA G VQI FSQ PDFDQLWW
AtAAP1(BAB83868)(145)  I LV GKS   F K HTAD   T SNYPYMAV GI QV LSQ PNFHKLS
BnAAP(CAD92449) (145)  I LV IGKA   Y NK HHAD  T SNYPYMAA G QT  LSQ PNFHKLS
AtAAP6(BAA97227)(141)  I MV VKRS   F KN HNVK ATSN P MII A IQIILSQ PNFHNLSW
```

FIGURE 34A

```
ZmAAP1(Mo17)     (184)  ██VL████C█STIAVG█ALGQT█SG-PTGKTTLY█TQV█VD█GSAEE█
    ZmAAP2       (192)  █II████S█SAIAVG█SLAQT█MG-PTGKTTMT█TLV█VD█D-AAQ█
OsAAP(BAD53557)  (178)  █IL█V██S█A█IAVG█SLAQT█MD-PLGRTTLT█TVV█VD█D-ATQ█
OsAAP(BAD53554)  (200)  █IL█V██S█STIAVG█SLART█SG-ATGKTTLT█VEV█VD█T-SAQ█
OsAAP(BAD37473)  (199)  █VL█V██S█SAIAVG█SLAQT█SG-PTGMTTMS█TVI██D█D-LSH█
RcAAP(CAA07563)  (197)  █IL█V██T█STIGLG█G█AQVVEN-GKAMGSVT█ISI█AN█T-PTQ█
AtAAP(AAM91305)  (188)  █IL█VM█T█SSAGLA█G█AQVVVN-GKVKGSLT█ISI█A-█T-ETQ█
AtAAP1(BAB83868) (195)  █IM█V██T█ATIGIG█A█ATV█GG-KVGKTSMT█TAV█VD█T-AAQ█
BnAAP(CAD92449)  (195)  █IM█V██A█ASIGIG█A█ATV█GG-KVGKTNMT█TVV█VD█T-AAQ█
AtAAP6(BAA97227) (191)  █IL█V██C█ASIGVG█S█AKAAGGGEHVRTTLT█VTV█ID█S-GAE█

ZmAAP1(Mo17)     (233)  I█LTF██L█NI█████S█TIV█████LRSP█-A█NKT█RQ█SVLGV█TT
    ZmAAP2       (240)  V█MTF██L█NV████S█AII█████LRSP█-A█NKT█RR█TMMG█STT
OsAAP(BAD53557)  (226)  V█LTF██L█NV████S█AII█████LRSP█-P█NAT█RR█TAAG█STT
OsAAP(BAD53554)  (248)  I█LAF██L█DI████S█SMI█████VKSP█-A█NKT█KK█TL█GVSTT
OsAAP(BAD37473)  (247)  I█QAL██L█NI████S█SLV█████IRSP█-A█SKT█RK█NALAMPVI
RcAAP(CAA07563)  (245)  I█RSF██L█DI████S█SII█████VRSP█-S█SKT█KK█TLISV█VT
AtAAP(AAM91305)  (235)  I█RTF██L█DI████S█SII█████VKSP█-S█EKT█KK█TLVSVSVT
AtAAP1(BAB83868) (243)  I█RSF██V█DI████A█ATV█████LRSS█-A█NKA█KR█SLVGVSTT
BnAAP(CAD92449)  (243)  I█RSF██V█DI████A█ATV█████LRSS█-A█NKA█KR█SFVGVSTT
AtAAP6(BAA97227) (240)  I█RTF██I█DI████A█STV█████LKAG█PS█NKA█KR█SLVGVSTT

ZmAAP1(Mo17)     (282)  A█IM█████L█SA█CNAAP█DI█S--█YE█Y██VDFA█VC█V██VG
    ZmAAP2       (289)  G█IMI█████A█GNAAS█NI█TGF█YE█Y██VDFA█ACIVV██VG
OsAAP(BAD53557)  (275)  G█LI█████S█GNAAP█NI█TGF█YE█Y██VDV█ACIVV██VG
OsAAP(BAD53554)  (297)  A█MI█████A█GNAAP█NM█TGF█YE█Y██IDFA█VCIVV██VA
OsAAP(BAD37473)  (296)  A█TI█████L█A█GNAAP█NM█TGF█YD█Y██VGLA█ACIVV██VA
RcAAP(CAA07563)  (294)  L█VM█████F█AA█DMSP█NL█TGF█YN█Y██LDIA█VAIVV██VA
AtAAP(AAM91305)  (284)  M█MI█████M█YA█DLSP█NL█TGF█YN█Y██LDI█AAIVI██IA
AtAAP1(BAB83868) (292)  F█YI█████I█YA█NNAP█DF█TDF█TE█F██IDFA█ACIAVI██GA
BnAAP(CAD92449)  (292)  F█YI█████L█AA█NKAP█DF█TNF█YE█F██DFA█ACIAF███GA
AtAAP6(BAA97227) (290)  F█MI█████V█AA█NDAP█NF█TGF█YE█F██DFA█VCIAV███GA

ZmAAP1(Mo17)     (330)  E█FL██L█AAV█ADVAARW█ACSARER---------RGG█DVF█LL█
    ZmAAP2       (339)  E█FC██L█AAV█GAVAAR██GSTREYG---------AAGLNVF█LV█
OsAAP(BAD53557)  (325)  F██FC█L█AAV█GGVARRC█GLLGGGAG-------RASG█NVF█LV█
OsAAP(BAD53554)  (347)  Y█FC██I█AAV█TFAARRW█GSEFITRERPV--VAGRSFS█NMF█LT█
OsAAP(BAD37473)  (346)  Y█MS██V█TAV█SWAS█SRW█RCGFFVTGG----GGTRLIS█NAF█LA█
RcAAP(CAA07563)  (344)  Y█YC█L█AFV█KAAAQRY█DSGFITKDIKIPYPGF█PFNL█LF█SV█
AtAAP(AAM91305)  (334)  Y█YC██L█AFI█KQASIQF█DSEFIAKDIKIPIPGF█PLRL█NVF█LI█
AtAAP1(BAB83868) (342)  Y█FA██I█QFV█KKCNRNY█DNKFITSEYS█NVPFLGKFN█SLF█LV█
BnAAP(CAD92449)  (342)  Y█FA██I█QFV█KKCNRNW█DNKFITSEYS█NIPFLGKFS█NLF█LV█
AtAAP6(BAA97227) (340)  Y█FC██I█QFV█SQSAKRW█DNKFITGEYK█H█PCCGDFS█NFL█LV█
```

FIGURE 34B

```
ZmAAP1(Mo17)    (370)  TAFYALITLCAVLL   NSIL IL SIG       FFYVE Y RQQQIPRE
      ZmAAP2    (379)  TAFYAVITLLAILM   NSIL IL SIA       FFYVE Y RQRQVRRE
OsAAP(BAD53557) (367)  TAFYAVITLLAILM   NSIL IL SIA       FFYVE Y RQRQLPRE
OsAAP(BAD53554) (395)  TAFYVVSTVLAIVM   NDIL FL AVG       YYFVE Y RQRRIQRY
OsAAP(BAD37473) (392)  TAY VACTAVAAVV   NDVL LL AVG       YFYVE Y RPRKLERS
RcAAP(CAA07563) (394)  LFYVFTTVISMLL    NDIV LL ALG       YFYVE Y AQKKIPKW
AtAAP(AAM91305) (384)  VFYIITTVISMLL    NDVV LL ALG       YFYVE Y AQKKIPRW
AtAAP1(BAB83868)(392)  AYYVITTVVAMF     RAIL LI AAS       YFYVE H AQTKIKKY
BnAAP(CAD92449) (392)  AYYVITTLVAMF     RAIL LI AAS       YFYVE H AQTKVKKY
AtAAP6(BAA97227)(390)  SY VVTAVVAMF     NDFL LI AAS       YFYIE H AQKKIPKF

ZmAAP1(Mo17)    (420)  SATYLA QALSIF FVITVAAGAA YQ VRDSLKTYV QTRS-
      ZmAAP2    (429)  STKYLA QSLSFV FLVTAASCAA YQ VVDSLKTYV KTRS-
OsAAP(BAD53557) (417)  SAKYVA QSLSLV FIVTVAACAA TQ VLDSLKTYV KTRS-
OsAAP(BAD53554) (445)  TSRYVA QTLSLL FIVSLASAVA TE VSESLKHYV KTKS-
OsAAP(BAD37473) (442)  SKPYVA QSLNAV FVVTLASAVA YQ IAESMAHYV KSKL-
RcAAP(CAA07563) (444)  STRYLC QILSAA LVITIAAAGS IA VVGDLKSVK QTSY-
AtAAP(AAM91305) (434)  STRYVC QVFSLG LVVSIAAAGS IA VLDLKSYK RSEY-
AtAAP1(BAB83868)(442)  SARYIA KIMCYV LIVSLLAAAG IA LISSVKTYK RTMHE
BnAAP(CAD92449) (442)  SSRYIG KMLCWV LIVSLLAAAG IA LISSVKTYK RTIHE
AtAAP6(BAA97227)(440)  SFTYIW KILSWT FIVSLVAAAG YQ LIQSLKDYK QAP--
```

FIGURE 34C

>ZmPESP protein and top 10 hits alignment

```
ZmPESP(MO17)         (1)   MGTRRRSNHPGCSFPLPFLVCGLLLAAAVAFSPAAAAEAADGGAGHEGRA
OsPESP(BAD53823)     (1)   MGPRRR--AGPLRLLRLLLVLWVAFAAVVAFCPAAAAAGEGVGVVEEEE
AtPESP(NP_849990)    (1)   -MRRCKNNTDKFSVITMRLLTLLLICTFFFFFSFAYSAESDN--------
AtPESP(NP_196741)    (1)   MVEGRR--RRRFSLSSQQLALLLLLLSFFLCFSVASPRAISDSLLDETV
AtPESP(AAL49821)     (1)   --------------MARFAVIGLTFLLELGTSLS---ARSDERTRER--
AtPESP(BAB11240)     (1)   --------------MARFAVIGLTFLLELGTSLS---ARSDERTRER--
AtPESP(CAB87698)     (1)   MVEGRR--RRRFSLSSQQLALLLLLLSFFLCFSVASPRAISDSLLDETV
OsPESP(NP_912478)    (1)   -MAPAAAGRVPLSRRRSTAALLLVALALVLGVQLRGAAARPDKEMREK--
NsPESP(BAB73745)     (1)   --------------------------------------------------
NpPESP(ZP_00101985)  (1)   --------------------------------------------------

ZmPESP(MO17)         (51)  GKPEVEAEAEARGDG----VAVAEAGGEVVAQGNATEAK----------E
OsPESP(BAD53823)     (49)  VRVGEAAAVARGEGDDAVVAAAVAGGEVAGEAGAGLGEGAAAANATGKE
AtPESP(NP_849990)    (42)  --------ETDS-------VVTREINGTVVESNATSAKP---------RE
AtPESP(NP_196741)    (49)  AN-----------------SSSSVASLNASSSSSLVKP----------KE
AtPESP(AAL49821)     (31)  -----------------------FYGNVVNSTAP-GNG----------E
AtPESP(BAB11240)     (31)  -----------------------FYGNVVNSTAP-GNG----------E
AtPESP(CAB87698)     (49)  AN-----------------SSSSVASLNASSSSSLVKP----------KE
OsPESP(NP_912478)    (48)  -----------------------FYGKEVTNGSGNATG----------D
NsPESP(BAB73745)     (1)   --------------------------------------------------
NpPESP(ZP_00101985)  (1)   --------------------------------------------------

ZmPESP(MO17)         (87)  GSIADMIDRALEKEFPESEGEQGGGETDPGSFNNIVAEKQICNANCSSCS
OsPESP(BAD53823)     (99)  GSIAEMIDRALEKEFPESEGEQGGGEKDPGSFNNIVAEK----------
AtPESP(NP_849990)    (68)  DSFADMIDRALEKEFPDNDQNEVP---DPGSFNNSVADQ----------
AtPESP(NP_196741)    (72)  GSFADIIDRALEKEFNESDQNEVA---DPGSFNNSVAG----------
AtPESP(AAL49821)     (46)  GSIAKMFDRVLEKEFSENDSPEGS---DGASFNSSVADQ----------
AtPESP(BAB11240)     (46)  GSIAKMFDRVLEKEFSENDSPEGS---DGASFNSSVADQ----------
AtPESP(CAB87698)     (72)  GSFADIIDRALEKEFNESDQNEVA---DPGSFNNSVAGQQFEYLNVRLVV
OsPESP(NP_912478)    (64)  GSIAEMFGRVLDKEFSDSDTPEAP---DKSSFNNSISDH----------
NsPESP(BAB73745)     (1)   --------------------------------------------------
NpPESP(ZP_00101985)  (1)   --------------------------------------------------

ZmPESP(MO17)         (137) F-YSYQGVLETVARRV-TK--KNETKDNK----------SFPFKEVFLDR
OsPESP(BAD53823)     (138) -----QGVLETVARRV-TK--KNETKDNK----------SFPFKEVFLDR
AtPESP(NP_849990)    (104) -----QAVLETVARVK-PK--KNETKTKE----------EKSFFNLDNEN
AtPESP(NP_196741)    (107) ----QQAVLETVARVKSTK--KNETKEEK----------RFQLHDVFNLN
AtPESP(AAL49821)     (82)  -----QAEIETVAKVTHEKGKRNDTQENNGTR-------PFQLQDVFSLE
AtPESP(BAB11240)     (82)  -----QAEIETVAKVTHEKGKRNDTQENNGTR-------PFQLQDVFSLE
AtPESP(CAB87698)     (119) VPCGDQAVLETVARVKSTK--KNETKEEKRIKRYLIFHRRFQLHDVFNLN
OsPESP(NP_912478)    (100) -----QAVLETVAVITHDK--KKNDSEQANSSK------PFQIGDMFGGQ
NsPESP(BAB73745)     (1)   --------------------------------------------------
NpPESP(ZP_00101985)  (1)   --------------------------------------------------

ZmPESP(MO17)         (173) TE--QEDVPTLIDR---------------K-----LDLRISKVVIVS
OsPESP(BAD53823)     (170) PE--QEDVPTLIDRKDNVFIISNPK---SKYFVLQLDLRISKVVIVS
AtPESP(NP_849990)    (136) G---VEDTPRLIDRKDNVFIMSNPK---SKYFVLQLDLRISKVVIVS
AtPESP(NP_196741)    (141) NDNRAEDTPTLIDRKDNVFIISNSK---SKYFVLQLDLRISKVVIVS
AtPESP(AAL49821)     (120) NED-SDDMT-LIDKKNNVFVMSNKK---SKYPILQVDLRISDVIIVF
AtPESP(BAB11240)     (120) NED-SDDMT-LIDKKNNVFVMSNKK---SKYPILQVDLRISDVIIVF
AtPESP(CAB87698)     (167) NDNRAEDTPTLIDRKVSFYTGRLSLDLLHYELHGSFGLVISKVVIVS
OsPESP(NP_912478)    (137) NEN-SDDLETVIDKEDNVFVMSNRK---SKYPTLQLDLRKVIVS
NsPESP(BAB73745)     (1)   ------------------------------MQEDFRKVKSVLAV
NpPESP(ZP_00101985)  (1)   ------------------------------MQEDFRKVKIVGV
```

FIGURE 35A

```
ZmPESP(MO17)       (201) RTCRSIAFACLGSSVKSITSSLASSIISPGSFSFVSMVQSSVSSSS
OsPESP(BAD53823)   (215) RTFSSIAFACLGSS--SITSSLASSIISPGSFSFVSMVQSSVSSSS
AtPESP(NP_849990)  (180) RTCSSIAFACAGSS--SITSSLASSIISPGSLSFVSMVQSSVSSSS
AtPESP(NP_196741)  (188) RTCSSIAFACAGSS--SITSSLASSIISPGSLNFISMVQSSVSSSS
AtPESP(AAL49821)   (165) RAISSIVFSCLGSS--SIVSSLASSIISPGSLKFISMVQSSVSSSS
AtPESP(BAB11240)   (165) RAISSIVFSCLGSS--SIVSSLASSIISPGSLKFISMVQSSVSSSS
AtPESP(CAB87698)   (217) RTCSSIAFACAGSS--SITSSLASSIISPGSLNFISMVQSSVSSSS
OsPESP(NP_912478)  (183) RTASSIIFSCLGSS--SIVSSLASSLVSPGSLNFISMVQSSFSSSS
NsPESP(BAB73745)    (18) RACSSLFAALLKSS--SLLSSIGMVSSASLGLIKSVISSSLSSSS
NpPESP(ZP_00101985) (18) RACSSLLAALLRSS--SLLSSIGMIVSPASLGLIKSVISSSLSSSS

ZmPESP(MO17)       (251) ISSSSSSLSSSTAKSRVVSAVAVSGGLLQISLFMFLCGSLATL---CSG
OsPESP(BAD53823)   (263) ISSSSSSLSSSTAKSRVVSAVAVSGGLLQISLFMLLCGSSATL---CSG
AtPESP(NP_849990)  (228) ISSSSSSLSSSAAKSRVVSAVASPGGLLQIFLFMCLSGSTASL---CSG
AtPESP(NP_196741)  (236) VSSSSSSLSSSTAKSKVVSSVAVSGGLLQISLFMFLCGSTVSL---CSG
AtPESP(AAL49821)   (213) VSSSSSSLSSSMTKSKVVGPVAVSGGLLQISLLMFLCGSTALL---CSA
AtPESP(BAB11240)   (213) VSSSSSSLSSSMTKSKVVGPVAVSGGLLQISLLMFLCGSTALL---CSA
AtPESP(CAB87698)   (265) VSSSSSSLSSSTAKS-----------------------------CSG
OsPESP(NP_912478)  (231) VSSSSSSLSSSLTKSKAVGPVAVSGGLLQISLFMFLCGSTAAL---CSA
NsPESP(BAB73745)    (66) ASSSSSSVSSSFAESKKVSASASGGCGLQIALTSSLTTVLVCGLTGAWSA
NpPESP(ZP_00101985) (66) ASSSSSSVSSSFAESKKVSASASGGGLQIALTSLVTVSVSGLSGAWST

ZmPESP(MO17)       (298) KTKESVSVSVLSSMSSSSSSLSFSMSRNSINALSSSVTVSISILSDCAVG
OsPESP(BAD53823)   (310) KTKESVSVSVLSSMSSSSSSLSFSMSRNSINALSSSVTVSTSILSDCAVG
AtPESP(NP_849990)  (275) KLSESISVSAFSSMSSSSSSLSFSMSRNSISALSSSITVSTSILSDCAVG
AtPESP(NP_196741)  (283) KRSESVSVSAFSSMSSSSSSLSFSMSRNSTNSLSSSVTISISILSDCAVG
AtPESP(AAL49821)   (260) RLSESISVSAFSSMSSSSSSVSFSVSRNSTSSLSSSVTISISIFSDCVVG
AtPESP(BAB11240)   (260) RLSESISVSAFSSMSSSSSSVSFSVSRNSTSSLSSSVTISISIFSDCVVG
AtPESP(CAB87698)   (284) KRSESVSVSAFSSMSSSSSSLSFSMSRNSTNSLSSSVTISISILSDCAVG
OsPESP(NP_912478)  (278) KSSESVSVGAFSSMSSSSSSSSFSVSKGSTNALSSSVTISTSILSAACSI
NsPESP(BAB73745)   (116) LPASSSVSLSSISLSLSSSSSLSCSMSRNETETPSSVMLSISVVSDLASG
NpPESP(ZP_00101985)(116) LPAKSMSLSSISLSSSSSSSLSCSMSRNETETPSSVMLSISVVSDLASG

ZmPESP(MO17)       (348) LLFALLPSLSGTSGSLHGSASMMKS---LVVLITFLTSSLSRSGVPWF
OsPESP(BAD53823)   (360) LLFALLPSLSGASGSLQGSASMSKS---LVVLITFLTSSLSRSGVPWF
AtPESP(NP_849990)  (325) LLFALLPSLSGTSGVLQGVSMSKS---LASLIAFLGASFVLSRSWVPWF
AtPESP(NP_196741)  (333) LLFALLPVLEGNSGSVHGMLSSGK---VVSLLLSFLAVLSSLSRSCSPWL
AtPESP(AAL49821)   (310) LLFALLPVLGGNSGSLQGSSMGKL---LSSLSTYLTVASSLTWSFVPRF
AtPESP(BAB11240)   (310) LLFALLPVLGGNSGSLQGSSMGKL---LSSLSTYLTVASSLTWSFVPRF
AtPESP(CAB87698)   (334) LLFALLPVLEGNSGSVHGMLSSGKGGFVAFVFGCFVNSSSDMYSLVAEAN
OsPESP(NP_912478)  (328) RSSN------------------------CCSYDDLSVICSSILETDDS
NsPESP(BAB73745)   (166) LMLAVLPALHE-----PGESISVAVLTALVRSGSFAAGAVAAGIWVSPPL
NpPESP(ZP_00101985)(166) LMLAVLPALNQ-----PAETIGIAVLTALSWSASFAAGAVAAGMWLSPPL

ZmPESP(MO17)       (395) LKLMSSLSSQTNELYQLAAVAFCLLFAWVSFYCSYIDFDLAYGPIFLYFI
OsPESP(BAD53823)   (407) LKLMSSLSSQTNELYQLAAVAFCLLFAW-----------
AtPESP(NP_849990)  (372) LKLMTSLSSQTNELYQLAAVAFCLLVAW-----------
AtPESP(NP_196741)  (380) LKLMVSLSSQTNELYQLAAVAFCLLVAW-----------
AtPESP(AAL49821)   (357) LKLMSQLSSQTNELYQLAAVAFCLLSAW-----------
AtPESP(BAB11240)   (357) LKLMSQLSSQTNELYQLAAVAFCLLSAW-----------
AtPESP(CAB87698)   (384) GQLSVTDSHMCVPSLIWSWCVFGNSSDK-----------
OsPESP(NP_912478)  (351) ASSAVRSQYHTNELYQLASVAFCLLSAW-----------
NsPESP(BAB73745)   (211) LRLSARTESR--ELSLLSVVALCLGSAL-----------
NpPESP(ZP_00101985)(211) LRLSARTESR--ELSLLGVVALCLGSAL-----------
```

FIGURE 35B

```
ZmPESP(MO17)       (445) IKTVFVKDLKCSDKGGSLELGSPAAGVRISTTDLRQHREQIEPIRNFF
OsPESP(BAD53823)   (435) ----------CSDKGGSLELGSPAAGVRISTTDLRQHREQIEPIRNFF
AtPESP(NP_849990)  (400) ----------CSDKGGSLELGSAAGVRISTTDLQHREQVEPIRNFF
AtPESP(NP_196741)  (408) ----------CSDKGGSLELGSPAAGVRISTTDLEHREQIEPIRNLF
AtPESP(AAL49821)   (385) ----------CSDKGGSLELGSSVAGVLISTTEFQHREQVEPIRNLF
AtPESP(BAB11240)   (385) ----------CSDKGGSLELGSFVAGVLSTTEFQHTEQVLILNSGR
AtPESP(CAB87698)   (412) ----------CSDKGGSLELGSPAAGVRISTTDLEHREQIEPIRNLF
OsPESP(NP_912478)  (379) ----------CSDYGGSLELGSSLAGVRISTTDFHHREQVEPIRNLF
NsPESP(BAB73745)   (237) ----------LTESGGSIRMKASVAGLRISEVEYSDQTYVEPIRDLF
NpPESP(ZP_00101985)(237) ----------LTEAGGSIRMKASVAGLRISEVEYSDQTYVEPIRDLF

ZmPESP(MO17)       (495) AALFLASGRIINVHSWNHVDILLAASILSITVSTFIVAIVGKGRGSN
OsPESP(BAD53823)   (475) AALFLASGRIINVHSWNHVDILLAASILSITVSTFIVAVVGKGRGSN
AtPESP(NP_849990)  (440) AALFLASGRIIHMHSWNHVDILLAASELSIVISTVVVATVSVGCNN
AtPESP(NP_196741)  (448) AALFLASGRIVNVHSWTHVDILLASSILSIEISTTIVTTVGKGGNN
AtPESP(AAL49821)   (425) AALFLGSIGRIINVHSWNHVDILLAGSILSIVISTAIAAVVGARNM
AtPESP(BAB11240)   (425) FCFASTCGRIINVHSWNHVDILLASSILSIVISTAIAAVVGARNM
AtPESP(CAB87698)   (452) AALFLASGRIVNVHSWTHVDILLASSILSIEISTTIVTTVGKGGNN
OsPESP(NP_912478)  (419) AALFLASGRIBVKSWNHVDILLAASILSIIVSVVVTVVGKAGGSI
NsPESP(BAB73745)   (277) ASLFFAAGHIDPVSLQNIELISGLASVFIGGFLITTPLKLRRPL
NpPESP(ZP_00101985)(277) ASLFFAAGHIDPVSWNNLELIIGLASVFIGGFLITTPLKLRRPL

ZmPESP(MO17)       (545) KTSLLVGMSLAQIGEFAFVLLSRASSSHLIEGKLRKLRKSTALSGVTS
OsPESP(BAD53823)   (525) KTSLLVGMSLAQIGEFAFVLLSRASSSHLIEGKLRKLRKSTALSGVTS
AtPESP(NP_849990)  (490) KTAVLVGMSLAQIGEFAFVLLSRASNLHLIESKLRKLRKSTALSGVTS
AtPESP(NP_196741)  (498) KTALLVGISLAQIGEFAFVLLSRASNLHLIEGKLRKLRKSTALSGVTS
AtPESP(AAL49821)   (475) RISFHVGVLLAQIGEFAFVLLSRASNLHVIEGKMRKLRKSTLSGVTS
AtPESP(BAB11240)   (475) RISFHVGVLLAQIGEFAFVLLSRASNLHVIEGKMRKLRKSTLSGVTS
AtPESP(CAB87698)   (502) KTALLVGISLAQIGEFAFVLLSRASNLHLIEGKLRKLRKSTALSGVTS
OsPESP(NP_912478)  (469) RTAFYG---------------KKRKLRKSTLSGVTS
NsPESP(BAB73745)   (327) KTALIAGLGLAQIGEFSFVLASEGQALGLVSRRVRKIRKSTAVTMLS
NpPESP(ZP_00101985)(327) KTAIIAGLGLAQIGEFSFVLASEGQSLGLVSRQIRKIRKSTAVTMLS

ZmPESP(MO17)       (595) LLFKMIRAMVHLGVLLRSFSVDIN--------QVELGLKNDVLRIDSGK-
OsPESP(BAD53823)   (575) LLFKMIRAVVHLGVLLRSFSVDSN--------QVELGLKSDGLRIDSGK-
AtPESP(NP_849990)  (540) LLFKLIRAVVHLGVLLRSFSPDS---------STEIGFKGELYHSESAK-
AtPESP(NP_196741)  (548) LFKMIRAVVHLGILLRSFSPDS-------------TIEKGEIVRSESGKQ
AtPESP(AAL49821)   (525) LLFKLISAMNLGVLLRSFPSEN-------------SSPNES-LQEKACL
AtPESP(BAB11240)   (525) LLFKLISAMNLGVLLRSFPSEN-------------SSPNEV-ILFSRSI
AtPESP(CAB87698)   (552) LFKMIRAVVHLGILLRSFSPDS-------------TIEKGEIVRSESGKQ
OsPESP(NP_912478)  (493) LIFKLIRVVMHLGILMRSFPSES-------------SMQNFLPLQDFATM
NsPESP(BAB73745)   (377) FVLRVLSAVFNFAESIPWLKPYIAGEGQALDISEDLPFQDHVVVCGYGRV
NpPESP(ZP_00101985)(377) FVLRLVSFLFNFAESMPWLKPYLE-EQEALDVSEDLPFKDHVVVCGYGRV

ZmPESP(MO17)       (636) RINLIVQGSHDS----------------------------
OsPESP(BAD53823)   (616) RINLIVQGSHDS----------------------------
AtPESP(NP_849990)  (580) RISLMIQGSLHDS---------------------------
AtPESP(NP_196741)  (586) RMILMSRQSHSS----------------------------
AtPESP(AAL49821)   (561) IEVHNRTK--------------------------------
AtPESP(BAB11240)   (561) YI--------------------------------------
AtPESP(CAB87698)   (590) RMILMSRQSHSS----------------------------
OsPESP(NP_912478)  (530) LEAYNRSL--------------------------------
NsPESP(BAB73745)   (427) GKNLYKLLQQHNMPVVVIDQSESRIQQLRDAEIPYVYGNCVSLHVLETAG
NpPESP(ZP_00101985)(426) GKNLYKLLLQHNLPVVVIDQSESRIQQLREAGVSYVYGNCVSLHVLETAG
```

FIGURE 35C

```
         ZmPESP(MO17)  (648) ------------------------------------------
      OsPESP(BAD53823) (628) ------------------------------------------
      AtPESP(NP_849990) (593) ------------------------------------------
      AtPESP(NP_196741) (598) ------------------------------------------
       AtPESP(AAL49821) (569) ------------------------------------------
       AtPESP(BAB11240) (563) ------------------------------------------
       AtPESP(CAB87698) (602) ------------------------------------------
      OsPESP(NP_912478) (538) ------------------------------------------
         NsPESP(BAB73745) (477) VSHAKGMAIALPDPMSTRLCVKRALELCPELDLVVRATQDKNIELLYQLG
      NpPESP(ZP_00101985) (476) VNHAKGMAIALPDPMSTRLCLKRALELRPELDLVVRATQDKNIEVLYQLG

ZmPESP(MO17)  (648) ------------------------------------------
      OsPESP(BAD53823) (628) ------------------------------------------
      AtPESP(NP_849990) (593) ------------------------------------------
      AtPESP(NP_196741) (598) ------------------------------------------
       AtPESP(AAL49821) (569) ------------------------------------------
       AtPESP(BAB11240) (563) ------------------------------------------
       AtPESP(CAB87698) (602) ------------------------------------------
      OsPESP(NP_912478) (538) ------------------------------------------
         NsPESP(BAB73745) (527) AREVVQPEFEASIEMATHLLTDVGWTS-GLLQQEMQQIRSDHYLDFRPER
      NpPESP(ZP_00101985) (526) AREVVQPEFEASLEMATYLLTGLGLLSSAVVQREMQQIRNDHYLDLRPER

ZmPESP(MO17)  (648) ------------------------------------------
      OsPESP(BAD53823) (628) ------------------------------------------
      AtPESP(NP_849990) (593) ------------------------------------------
      AtPESP(NP_196741) (598) ------------------------------------------
       AtPESP(AAL49821) (569) ------------------------------------------
       AtPESP(BAB11240) (563) ------------------------------------------
       AtPESP(CAB87698) (602) ------------------------------------------
      OsPESP(NP_912478) (538) ------------------------------------------
         NsPESP(BAB73745) (576) NADEVSRHLQQATQDLNRRWYALPADSPLIGMNLEEADMRYLTGVSLMAI
      NpPESP(ZP_00101985) (576) SATEVARDLRQATRDLNQRWYPLPADSPLIGMSIEEADMRYLTGASLMAI

ZmPESP(MO17)  (648) ------------------------------------------
      OsPESP(BAD53823) (628) ------------------------------------------
      AtPESP(NP_849990) (593) ------------------------------------------
      AtPESP(NP_196741) (598) ------------------------------------------
       AtPESP(AAL49821) (569) ------------------------------------------
       AtPESP(BAB11240) (563) ------------------------------------------
       AtPESP(CAB87698) (602) ------------------------------------------
      OsPESP(NP_912478) (538) ------------------------------------------
         NsPESP(BAB73745) (626) RRANGEEIDYPSNQTKLAAGDRLLIVGAKEELAALEEFAQGKVGVPGQNS
      NpPESP(ZP_00101985) (626) RRANGDEIDYPNNQTKLEDGDRLLVVGADEELAALAEFAKGQAAVPGENS

ZmPESP(MO17)  (648) ------------------------------------------
      OsPESP(BAD53823) (628) ------------------------------------------
      AtPESP(NP_849990) (593) ------------------------------------------
      AtPESP(NP_196741) (598) ------------------------------------------
       AtPESP(AAL49821) (569) ------------------------------------------
       AtPESP(BAB11240) (563) ------------------------------------------
       AtPESP(CAB87698) (602) ------------------------------------------
      OsPESP(NP_912478) (538) ------------------------------------------
         NsPESP(BAB73745) (676) ACQWVAVDANSAVLGKTLKDLALDIQSGIKVQAIRRDGKFIRSPNDNIDL
      NpPESP(ZP_00101985) (676) ACQWVTVNADTPTLGKTLADLDINKQFGVQVQAIRRDGKFIRYPDGGMDL
```

FIGURE 35D

```
       ZmPESP(MO17)     (648) --------------------------------------------------
    OsPESP(BAD53823)    (628) --------------------------------------------------
   AtPESP(NP_849990)    (593) --------------------------------------------------
   AtPESP(NP_196741)    (598) --------------------------------------------------
     AtPESP(AAL49821)   (569) --------------------------------------------------
     AtPESP(BAB11240)   (563) --------------------------------------------------
     AtPESP(CAB87698)   (602) --------------------------------------------------
    OsPESP(NP_912478)   (538) --------------------------------------------------
     NsPESP(BAB73745)   (726) RTGDQVLLCGSLPSLNQIQPLFAVVNEIPLAIPIVKAKETEVVKEMRG--
   NpPESP(ZP_00101985)  (726) RVGDQVLLCGSLTGLSQIEQLFAIASSLPLSLPVLKAVQAEALKEFLPAD

ZmPESP(MO17)     (648) ---
    OsPESP(BAD53823)    (628) ---
   AtPESP(NP_849990)    (593) ---
   AtPESP(NP_196741)    (598) ---
     AtPESP(AAL49821)   (569) ---
     AtPESP(BAB11240)   (563) ---
     AtPESP(CAB87698)   (602) ---
    OsPESP(NP_912478)   (538) ---
     NsPESP(BAB73745)   (774) ---
   NpPESP(ZP_00101985)  (776) SVD
```

FIGURE 35E

>ZmS24 Protein and top 10 hits alignment

```
     ZmS24(Mo17)   (1)  MADSKAAA TRTRKFMT  S  QF LE     RPN S AELKERL
  ZmS24(AAG23693)  (1)  MADSKATSA TSALGKFMT   A  QF LE     RAN S AELKERL
   OsS24(BAD53549) (1)  MSESKAAA TRTRKFMT   S  QF LE L   RAN S ADLKEKL
  OsS24(NP_916712) (1)  MSDSKAAA TRTRKFMT   S  QF LE     RPN S AELKEKL
   OsS24(XP_464768)(1)  MAD KTAP TRTRKFMT   S  QF LE L   RAN S ADLKEKL
    AtS19(AAM16200)(1)  ----MAEK  TRTRKFMT  S  QF ID L   RAN S AELKEKL
    AtS19(AAM63791)(1)  ----MAEK  TRTRNFMT   A  QF ID L   RAN S AELKEKL
    AtS19(AAL66893)(1)  ----MAEK  TRTRNFMT   A  QF ID L   RAN S AELKEKL
    AmS24(XP_623734)(1) ----MTEG  TRTRKFMS   C   VD F   HPS R TE REKL
    DdS24(AAS38787)(1)  ----MDKA  VRTRKVLT  S  QF VF V   RAN S KDLKT T

ZmS24(Mo17)  (51)  K YE KDPNCI V K R HE    TGFG   NLEA  F     I N
  ZmS24(AAG23693) (51)  KMYE KDPNTI V K R HE    TGFG   NLES  F     I N
   OsS24(BAD53549)(51)  K YE KDSNCI V K R HE    TGFG   NLDA  Y     I N
  OsS24(NP_916712)(51)  K YE KDANCI V K R HE    TGFG   NLDA  Y     I N
   OsS24(XP_464768)(51) K YE KDSNCI V K R HE    TGFG   NLDA  Y     I N
    AtS19(AAM16200)(47) RMYE KDPNAI V K R HE    S FG   DTVES F     I N
    AtS19(AAM63791)(47) RMYE KDPNAI C K R HE    S YG   DTVEN F     I N
    AtS19(AAL66893)(47) RMYE KDPNAI C K R HE    S YG   DTVEN F     I N
    AmS24(XP_623734)(47)KMYK T-PDV V GFQ N     TGFA   DTLDF F     A H
    DdS24(AAS38787)(47) KL HK ADPETI L GFKTD   TGFG   NLEI  V     A A

ZmS24(Mo17) (101)   AT VEKS QM R N A  IRGVKKT AGDAKKK--
  ZmS24(AAG23693)(101)   AT VEKS QM R N A  IRGVKKT AGDAKKK--
   OsS24(BAD53549)(101)  AT VEKS QM R N A  IRGVKKT AGDAGKKK-
  OsS24(NP_916712)(101)  AT VEKS QM    A  IRGVKKT AGDAGKKK-
   OsS24(XP_464768)(101) AT VEKS QM R N A  IRGVKKT AGDAGKKK-
    AtS19(AAM16200)(97)  DT IEKS QI R N A  IRGVKKT AGDAKKK--
    AtS19(AAM63791)(97)  DT IEKS QI R N A  IRGVKKT AGDAKKK--
    AtS19(AAL66893)(97)  DT IEKS QI R N A  IRGVKKT AGDTKKK--
    AmS24(XP_623734)(96) FE QKQ  QR P N M VRGTKKS VGAASKKVK
    DdS24(AAS38787)(97)  YT PQTS  R K N L AGKKTAK---------
```

FIGURE 36

>ZmABCT protein and top 10 hits alignment (updated)

```
ZmABCT(partial, Mo17)   (1)   ---MESAMEKVWESGRRMSRSIGRGMGMGMETWGVDDAFVPQHGS-----
    ZmABCT(Composite)   (1)   ---MESAMEKVWESGRRMSRSIGRGMGMGMETWGVDDAFVPQHGS-----
     OsABCT(BAD53545)   (1)   ---MESAMEKVWESGRRMSRSIGR--GMGMEAWGVDEAFMPQNSGGGGGS
    OsABCP(NP_916719)   (1)   MADPQHVQEEAAGAEAVHAHAARHDGAVVMEISRSLQSMPASPDVSAYF
     AtABCT(AAD39329)   (1)   ------------MDYNPNLPPLGGGGVSMRRGISRSVSRASRNIE-----
     AtABCT(DAA00875)   (1)   ------------MDYDPAHAMSRGG--SMRQTISRSVSKASRNME-----
     AtABCT(AAD39650)   (1)   ------------MDYDPAHAMSRGG--SMRQTISRSVSKASRNME-----
     AtABCT(BAB01273)   (1)   ----------------------METLSRSISKSLGELLASNS-----
     OsABCT(XP_464576)  (1)   -----------------MDIVRMGSVASGGGSVRRTASSWRGTSG----R
       SpABCT(CAA94437) (1)   --------------MEIAGYRGGSLRGSLQGSERRSVSAWRSPS-----T
       OsABCT(CAD59574) (1)   -----------------MAAAPSASGRRSMSWGSSISQSFRQAE----A ZmABCT(partial, Mo17)  (39)   ---RSRGGGGGGGDD    A  R   AI  R   TYS V TAILSTEAAAGVDDD
    ZmABCT(Composite)  (39)   ---RSRGGGGGGGDD    A  R   AI  R   TYS V TAILSTEAAAGVDDD
     OsABCT(BAD53545)  (42)   R-GRRRSGRGGTADD    A  R   AI  R   TYS M TAILSSAEEEAAAAA
    OsABCP(NP_916719)  (51)   SGASSRRPSAADEVD    A  R   AL  R   SFD L T LMRADADSSGVGV
     AtABCT(AAD39329)  (34)   DIFSSGSRRTQSVND    A  K   AI  K   TYS L TTLMNAVVEDDVYGN
     AtABCT(DAA00875)  (32)   DIFNTSSRRTKSVNE    A  K   SI  K   TYN L TSLMPELGEDDVYGN
     AtABCT(AAD39650)  (32)   DIFNTSSRRTKSVNE    A  K   SI  K   TYN L TSLMPELGEDDVYGN
     AtABCT(BAB01273)  (21)   NNHFSRRSGSTIDD     A  K   AL  K   TFAS L TTIIHPH--------
     OsABCT(XP_464576) (30)   SDAFGRSVREE---D    A  K   AI  K   TYD M KGILTAGG--VEEVD
       SpABCT(CAA94437)(32)   SDVFGRSSREE---D    A  K   AI  K   TYD L KGIMTGDGGEIQEVD
       OsABCT(CAD59574)(29)   DDPFGRASQQGHDD     I  R   AL  K   TYD M RCVERTALLHHDGGG ZmABCT(partial, Mo17)  (86)   DDKPRRPPPQQQQFKEVDVRKLGVGSRQEFIERVFRVAEEENQRFLQKLS
    ZmABCT(Composite)  (86)   DDKPRRPPPQQQQFKEVDVRKLGVGSRQEFIERVFRVAEEENQRFLQKLS
     OsABCT(BAD53545)  (91)   AGAGK------QQYKEVDVRRLGVGRPQEFIERVFRVAEEINQRFLQKLS
    OsABCP(NP_916719) (101)   GAVGRGR--RWYAHREVDVRTLELAQRQAFVERVFRVAEERNERFRKKLS
     AtABCT(AAD39329)  (84)   QLM---------SKEVDVTKLDGEDRQKFIDMVFKVAEQQNERIITKLS
     AtABCT(DAA00875)  (82)   QIL---------NKAVDVTKLDGESRQKFIDMVFKVAEQNERIITKLS
     AtABCT(AAD39650)  (82)   QIL---------NKAVDVTKLDGESRQKFIDMVFKVAEQNERIITKLS
     AtABCT(BAB01273)  (63)   -----------EDLVDVTKLGVDRQKFIDSIFKVTEEQNEKFKKFS
     OsABCT(XP_464576) (75)   IGGLGLQERRN---------------LIERLVRTAEEENERFLKLS
       SpABCT(CAA94437)(79)   IQGLGFQERKN---------------LLEKLVRNAEEENERFLKLS
       OsABCT(CAD59574)(79)   DGGGAAAAAKDGRMELVDIQKLAAGNL--GRALEDRVFQDSERFRRLS ZmABCT(partial, Mo17) (136)   NKIDRVG EL  VE   FERLTVE RCHVGSRALTLLNTARNVAEAALGL
    ZmABCT(Composite) (136)   NKIDRVG EL  VE   FERLTVE RCHVGSRALTLLNTARNVAEAALGL
     OsABCT(BAD53545) (135)   NKIDRVG EL  VE   FEELMVQ RCHVGSRALTLLNTARNIAEAALGL
    OsABCP(NP_916719) (149)   AKIDRAG QM  VE   FRNYRVQ ECHVGTRALTLAVSRDVGESLLGL
     AtABCT(AAD39329) (124)   NKIDRVG KL  VE   YEHLTIK DCYTGNSSLTLLVVRNMGESALGM
     AtABCT(DAA00875) (122)   NKIDRVG QL  VE   YDHLTVK DCYTGDKSLSLLAVRNMGEAALGM
     AtABCT(AAD39650) (122)   NKIDRVG QL  VE   YDHLTVK DCYTGDKSLSLLAVRNMGEAALGM
     AtABCT(BAB01273) (100)   NKIDRVR KL  VE   FEKVTIE NCHIKKALSTLPNAALNIAERGLRL
     OsABCT(XP_464576)(107)   DRMERVG DN  IE   FENLSID EAYVGIRGISTFTNFFSNKIMDVLSA
       SpABCT(CAA94437)(111)  NRMERVG DN  IE   FEHLRIN EAFVIRGVSTLVNFFVNKAIWILSA
       OsABCT(CAD59574)(127)  DKIDMVG EL  VE   YEQLSIQ EVFVGSRALTLTAATNVLQGLIGR
```

FIGURE 37A

```
ZmABCT(partial, Mo17)  (186) CGVRLGGRQARLT  RDV  AVR S  T  L   SS  TT LL  A
   ZmABCT(Composite)   (186) CGVRLGGRQARLT  RDV  AVR S  T  L   SS  TT LL  A
     OsABCT(BAD53545)  (185) VGVRPG-RQATLT  RGV  AVR S  T  L   SS  TT LL  A
     OsABCP(NP_916719) (199) VCLNFA-KRKALH  KDV  IVR S  T  L   SS  TT LL  A
      AtABCT(AAD39329) (174) IGIQFR-KKAQLT  KD   VIK C  T  L   SS  TT LL  A
      AtABCT(DAA00875) (172) IGIRLA-KKAQLT  KDV  IVK S  T  L   SS  TT LL  A
      AtABCT(AAD39650) (172) IGIRLA-KKAQLT  KDV  IVK S  T  L   SS  TT LL  A
      AtABCT(BAB01273) (150) LGFNFT-KTTKVT  RDV  IIK  S  T  L   SS  TT LL  A
       OsABCT(XP_464576)(157) MRIVSS-GKRPIS  HD   IIR      L   GS  TS LL  A
      SpABCT(CAA94437) (161) LHLMPS-GKRPIS  HDV  ILK C  T  L   GA  TT LL  A
      OsABCT(CAD59574) (177) FGSS---NKRTI   QDV  IIK S  T  L   SS  QT MR  T ZmABCT(partial, Mo17)  (236) PA VVA VGGGEVS    FRLG  VFQK A  IS T V VGE  K  D
   ZmABCT(Composite)   (236) PA VVA VGGGEVS    FRLG  VPQK A  IS T V VGE  K  D
     OsABCT(BAD53545)  (234) PS RRC E----VT    FELE  VAQK A  IS T V VGE  K  D
     OsABCP(NP_916719) (248) PT ETS EVT----    YGLD  VFQK A  IS H V  AGE  K  D
      AtABCT(AAD39329) (223) KS QVS  T----     QLD   VPF  S  IS N L  VGI  K  D
      AtABCT(DAA00875) (221) KS DVS EVT----    YRLN  VPIK S  IS N L VGI  K  D
      AtABCT(AAD39650) (221) KS DVS EVT----    YRLN  VFIK S  IS N L VGI  K  D
      AtABCT(BAB01273) (199) QS KVT RVT----    HGLE  VPQK S  IS N V VGV     D
       OsABCT(XP_464576)(206) SI KVS PVT----    HDMD  VPQK S  IG H L GE  K  A
      SpABCT(CAA94437) (210) NI KVT  RVT---    GMH   VPQR S  IS H V  GE  R  A
      OsABCT(CAD59574) (224) KN KVS  IT----   C HTFS YPE  S  VS Y L NAE  R  D ZmABCT(partial, Mo17)  (286)  AR QGV AK DL  T  ARR KGAG R EPEV LF  ATSMEGVENSLQ
   ZmABCT(Composite)   (286)  AR QGV AK DL  T  ARR KGAG R EPEV LF  ATSMEGVENSLQ
     OsABCT(BAD53545)  (280)  AR Q  V TR DLL T  ARR KEAG R EPEV LF  ATSMEGVESSLQ
     OsABCP(NP_916719) (294)  AK Q V QR ELLK  AKK RQLG Y DPEV LF  ATSVEG--STLQ
      AtABCT(AAD39329) (269)  AR Q V TR DLLN   ARR KDAG F EADV LF  ASAAQGVKNSLV
      AtABCT(DAA00875) (267)  AR Q V TR DLL     ARR KDAG F EADV LF  ASAAQGVKSSLI
      AtABCT(AAD39650) (267)  AR Q V TR DLLN   ARR KDAG F EADV LF  ASAAQGVKSSLI
      AtABCT(BAB01273) (245)  AR Q V TR DLL    VRR KDAG L EPEV LF  SIAAGVVKSSLI
       OsABCT(XP_464576)(252)  AR Q V TR DMLT   GRR KEAS K DPDI VY  AISVEGQES-VV
      SpABCT(CAA94437) (256)  SR Q V TR EMLT   GRR KEA  K DPDV VY  AVAVEGQES-VV
      OsABCT(CAD59574) (270)  GR LGI AR DMLA   ARR R AG K DPEI AF  ATAVQGHKT IT ZmABCT(partial, Mo17)  (336)  YT RI  DI A TIV  QMQ          RV  ANDTVECHILRFVQK
   ZmABCT(Composite)   (336)  YT RI  DI A TIV  QMQ          RV  ANDTVECHILRFVQK
     OsABCT(BAD53545)  (330)  YT RI  DI A TIV  QMQ          RV G--------------
     OsABCP(NP_916719) (342)  YI RI  DM A IV   E RR         RL A--------------
      AtABCT(AAD39329) (319)  YT KI  DI K TIV  DM           RV G--------------
      AtABCT(DAA00875) (317)  YT KI  DI K TIV  DMM          RV G--------------
      AtABCT(AAD39650) (317)  YT KI  DI K TIV  DMM          RV G--------------
      AtABCT(BAB01273) (295)  YT RI  DI K TV   EMI          RV G--------------
       OsABCT(XP_464576)(301)  YI KI   I A TMV  AM           RV G--------------
      SpABCT(CAA94437) (305)  YI KI  DI A TMV  GMI          RV G--------------
      OsABCT(CAD59574) (320)  VT KA  DI A II   EMI          RV G--------------
```

FIGURE 37B

```
ZmABCT(partial, Mo17)  (386) KKELCFCAVPLRSTHTRDTVPLIGTQQLVAYHLVVQGFQG   IV  TKV
   ZmABCT(Composite)   (386) KKELCFCAVPLRSTHTRDTVPLIGTQQLVAYHLVVQGFQG   IV  TKV
     OsABCT(BAD53545)  (366) ----------------------------------------   IV  TKV
     OsABCP(NP_916719) (378) ----------------------------------------   LV  TKV
     AtABCT(AAD39329)  (355) ----------------------------------------   IV  TKT
     AtABCT(DAA00875)  (353) ----------------------------------------   IV  TKT
     AtABCT(AAD39650)  (353) ----------------------------------------   IV  TKT
     AtABCT(BAB01273)  (331) ----------------------------------------   IV  TKT
     OsABCT(XP_464576) (337) ----------------------------------------   LV  AKA
     SpABCT(CAA94437)  (341) ----------------------------------------   IV  SKA
     OsABCT(CAD59574)  (356) ----------------------------------------   LT  ARA ZmABCT(partial, Mo17)  (436)           T FQ VKCLQQI HLGEA ILMS   QPA  TFD    I
   ZmABCT(Composite)   (436)           T FQ VKCLQQI HLGEA ILMS   QPA  TFD    I
     OsABCT(BAD53545)  (376)           T FQ VKCLQQI HLGEA ILMS   QPA  TFE    I
     OsABCP(NP_916719) (388)           T FQ IRCIQQI HMGEA VLVS   QPA  IFE    V
     AtABCT(AAD39329)  (365)           T FQ VKCLQQI HLNEA VLMS   QPA  TFD    I
     AtABCT(DAA00875)  (363)           T FQ VKCLQQI HLTEA VLIS   QPA  TFD    I
     AtABCT(AAD39650)  (363)           T FQ VKCLQQI HLTEA VLIS   QPA  TFD    I
     AtABCT(BAB01273)  (341)           T YQ VKCLQEI RFTDA VLMS   QPA  TFE    I
     OsABCT(XP_464576) (347)           T YQ VNSLRQS HILGG ALIA   QPA  TYD    I
     SpABCT(CAA94437)  (351)           T FQ VNSLRQS HILGG ALIA   QA   TYD    I
     OsABCT(CAD59574)  (366)           S FE VKYIGHL HVMNE VMIS   QPS  TY     I ZmABCT(partial, Mo17)  (486) I L E Q    QG  EYV E  DSCG C  E  GT        R   E
   ZmABCT(Composite)   (486) I L E Q    QG  EYV E  DSCG C  E  GT AD  Q  SR  GEC
     OsABCT(BAD53545)  (426) I L E Q    QG  EYV E  ESCG R  E  GT AD  Q  SK  GES
     OsABCP(NP_916719) (438) M L E Q    QS  EHV E  ERCG R  E  GV AD  Q  KE  QE
     AtABCT(AAD39329)  (415) I V E Q    QG  D  IKE  ESF K  E  KS TA  Q  KK  QE
     AtABCT(DAA00875)  (413) I L E Q    QG  DHI E  ESF K  E  KG TA  Q  KE  QE
     AtABCT(AAD39650)  (413) I L E Q    QG  DHI E  ESF K  E  KG TA  Q  KE  QE
     AtABCT(BAB01273)  (391) I L E Q    QG  DHV T  ETC K  E  KS TA  Q  SR  QE
     OsABCT(XP_464576) (397) V L E Q    QG  EN  E  EAMG K  E  GV AD  Q  SR  QH
     SpABCT(CAA94437)  (401) L L D Q    QG  ENV E  ESM K  E  KG VA  Q  R   QQ
     OsABCT(CAD59574)  (416) I L E Y       EM  E  EVA R  E  KS ID  Q  KK  QQ ZmABCT(partial, Mo17)  (536)  ADKQMP  RYVS  PE AQRFKR  V LQLENRLS   FDKSRC QAA  VFS
   ZmABCT(Composite)   (536)  ADKQMP  RYVS  PE AQRFKR  V LQLENRLS   FDKSRC QAA  VFS
     OsABCT(BAD53545)  (476)  ADKHRP  RYIS  SE AQRFKR  V LQLENHLSV  FDK RS  QAA  VFS
     OsABCP(NP_916719) (488)  IQSEKP  RYVS  PE VAKFKK  MKSLKKQLSV  FNKG I  K A  VFS
     AtABCT(AAD39329)  (465)  VNP RP  HYIP  SE ASPYKS  V TKMSNELA  FDKSRG  KAA  VFD
     AtABCT(DAA00875)  (463)  VDPNRP  RYIP  SE ASSFK   V SKLSNELSV YDKSKS  KAA  MFD
     AtABCT(AAD39650)  (463)  VDPNRP  RYIP  SE ASSFK   V SKLSNELSV YDKSKS  KAA  MFD
     AtABCT(BAB01273)  (441)  ADSKEP  SYIS  SE KRFRT   V ANLE DLSV YDRFKS  PA   VFK
     OsABCT(XP_464576) (447)  CRRDEP  RYIS  ND EAFKE   V RNLGCELRV FDR RN  PAA  TTS
     SpABCT(CAA94437)  (451)  VRE EP  R VP  NE EAFKS   V AKLHEELST FDRSRN  PAA  TTS
     OsABCT(CAD59574)  (466)  YHDQER  RYVS  PE AQRFKS   V QKMQKEMQI YDKSST  PAA  TT ZmABCT(partial, Mo17)  (586) K SVST ELLKAS DK WL IK   S V IF TI LII ALIAS VFL  H
   ZmABCT(Composite)   (586) K SVST ELLKAS DK WL IK   S V IF TI LII ALIAS VFL  H
     OsABCT(BAD53545)  (526) KQSVST ELLKAS AK WL IK   S V IF TI LIV AL AS VFL  Q
     OsABCP(NP_916719) (538) KQSVST LELLKT CSK WL MK  S V IF TV GIL ALIAS VFL  Q
     AtABCT(AAD39329)  (515) KYSVSK RELLK C DK WL MQ   A F VF TV IVI AAITS  FL  E
     AtABCT(DAA00875)  (513) KYS KK TELLK C WDK WM MK  S F V F TV  II AAITS  YL  E
     AtABCT(AAD39650)  (513) KYS KK TELLK C WDK WM MK  S F V F TV  III AAITS YL  E
     AtABCT(BAB01273)  (491) K SVP K QLFKVC WDR LL MK   A F IT TV  II MALIAS V L  E
     OsABCT(XP_464576) (497) RYG SK MELTKAC   R WL MK  S V IF IL LII GSI M  VFL  K
     SpABCT(CAA94437)  (501) KYG SK MELLKAC DR WL MK   S V T F VV LIV ALIAM VFF  K
     OsABCT(CAD59574)  (516) KYG SS WESLRAVMSR WL MK   S   IF V T LII A MGM VFL  K
```

FIGURE 37C

```
ZmABCT(partial, Mo17)  (636) MHTTNLDRGFVYISALLFTLIVNMRNGFRELSLTITRRVFYRRQLRFY
    ZmABCT(Composite)  (636) MHTTNLDRGFVYISALLFTLIVNMRNGFRELSLTITRRVFYRRQLRFY
      OsABCT(BAD53545)  (576) MHTRNLDRGFVYISALLFSLIVNMRNGFRELSLTITRRVFFRHRQLRFY
      OsABCP(NP_916719) (588) LNTRDEDRGQIYISALRFVNITNMRSGFRDLSLTLARRVFYRHRQFRFY
        AtABCT(AAD39329) (565) MFTRNEGRANLYIGALLFGMIRNMRNRFREMAMMVSRRVFYRQSRQLRFY
        AtABCT(DAA00875) (563) MHTRNEIRANIYVRSLLFAMIVNMRNGLREMAMTIQRRVFYRQRRLRFH
        AtABCT(AAD39650) (563) MHTRNEIRANIYVRSLLFAMIVNMRNGLREMAMTIQRRVFYRQRRLRFH
        AtABCT(BAB01273) (541) MGTRNESRGAVYISALMFSMIVNMRNGFRELALMIQRRVFYRQRSLRFH
       OsABCT(XP_464576) (547) MHRRSVFRGATFLRAMFLGLVTHLRNGFRELAMSIAKRITYRQRSLRFY
       SpABCT(CAA94437) (551) LPRNGLFRATIFFRAMFLGLVTHLRNGFRELAMSIAKRVFYRQRSLRFY
       OsABCT(CAD59574) (566) MPSGTISRGTKFLRALTFSLITILFNGFRELQLTIKRRVFYRHRQFLFF ZmABCT(partial, Mo17)  (686) PARVFTVPNVLLRIRFRIRRSIVRVLVRRTIRFARDADRFFKHLLLRFL
    ZmABCT(Composite)  (686) PARVFTVPNVLLRIRFRIRRSIVRVLVRRTIRFARDADRFFKHLLLRFL
      OsABCT(BAD53545)  (626) PARIFTLPNVLLRIRFRIRRSIVRVLVRRTIRFARRADRFFKQLLLRFL
      OsABCP(NP_916719) (638) RPRTFALPNVLVRIRSRLFRSIRRVARIRRTMRFARRASRFFKHLLVRFM
        AtABCT(AAD39329) (615) PSRTFSLPTFLLGIRSRILRSTARMVVRRSIRFARDASRFFKQFLLRFL
        AtABCT(DAA00875) (613) PFRTYTLPTTLLGIRIRIFRSTARMVVRRSIRYARDAERFFKQFLLIFL
        AtABCT(AAD39650) (613) PFRTYTLPTFLLGIRIRIFRSTARMVVRRSIRYARDAERFFKQFLLIFL
        AtABCT(BAB01273) (591) PFRTFSLPTFLLGIRIRIFRSVVRVTIRRMIRFARELSRFLKHLLVIFL
       OsABCT(XP_464576) (597) PSRAYALPTWVLKIRIRFLRRCAVRICMRIRVMRFDRNIERFFRHYVLRVL
       SpABCT(CAA94437) (601) PPRARALPTWILKIRIRPVRCGVRTAMRRRVIRFDRNVVRMFRHYLLRVL
       OsABCT(CAD59574) (616) PARTFCRANLLLRVPVRLVRAAVRVVLRRVMRFARSAGRFFRQRIAFFV ZmABCT(partial, Mo17)  (736) IQRMRGGLFRATAGLCRSMIIAQRGRALFLRIFFVLRGRVLPKVFRPNWR
    ZmABCT(Composite)  (736) IQRMRGGLFRATAGLCRSMIIAQRGRALFLRIFFVLRGRVLPKVFRPNWR
      OsABCT(BAD53545)  (676) IQRMRGGLFRATAGLCRSMIIAQRGRALALRIFFVLRSRLLPKAFRPKWR
      OsABCP(NP_916719) (688) LQRMRAGLRRVTAGLCRTVVRTNRARSLAVRIMFVLRCRILPKDARPKWR
        AtABCT(AAD39329) (665) MQRMRASLRRLIASVCRTRMIANRGGALTLLRLVFLLRCRLLPKGKRPDWR
        AtABCT(DAA00875) (663) IQRMRAGIFRFIASTCRTMTIANRGRVLVLRVVFLTRCRLLPRSERPVWR
        AtABCT(AAD39650) (663) IQRMRAGIFRFIASTCRTMTIANRGRVLVLRVVFLTRCRLLPRSERPVWR
        AtABCT(BAB01273) (641) TQRMRGGIRRFIAATCRSMILANRGRALVRLLFLLCRSRVPRGERPKWR
       OsABCT(XP_464576) (647) ISRMRSGLFRLLAALGREMVVADRFGRFAQRILLVLRCRLISRENRKKWR
       SpABCT(CAA94437) (651) ISRQVRSGLFRLLAAVGRDMVVADRFRAFAQLRVLLVLRCRIIAREKRKKFR
       OsABCT(CAD59574) (666) THRMRMAMFRFLGAILKTMVVANRFSMFVLRIVFRFGRRLISRNDRKPWR ZmABCT(partial, Mo17)  (786) IRGRRIRRLMRGYNALA--------------------------------
    ZmABCT(Composite)  (786) IRGRRIRRLMRGYNALAVNEFYAPRWMNKFVLDQNGVPKRLGIAMLEGAN
      OsABCT(BAD53545)  (726) IRGRRVRRLMRGYNALAVNEFYSPRWMNKFVLDNNGVPKRLGIALHEGAN
      OsABCP(NP_916719) (738) VRARCRRLTYAVIAFSNEMHQPRWMDKFVPDGKR----LGVAVLENSG
        AtABCT(AAD39329) (715) GRARVRRLTRAFNGLVVNEMFAPRWMNKMASSNS--TIKLGTMVLNTWD
        AtABCT(DAA00875) (713) RRARIRRLSRAFNAITVNELFAPRWMNKMSG-NS--TTRLGTSVLNIWD
        AtABCT(AAD39650) (713) RRARIRRLSRAFNAITVNELFAPRWMNKMSG-NS--TTRLGTSVLNIWD
        AtABCT(BAB01273) (691) KRARVRRMARTYDALVVNEMLAPRWINQPSS-DN--STSLGLAVLEIFD
       OsABCT(XP_464576) (697) IRGYRSRRLMRAQNAIAVNEFLGHSWNKVVDPTQS--NDTLGVQVLKVRG
       SpABCT(CAA94437) (701) IRGTRSRRLMRAQNAIAVNEFLGHSWNKLVDATG----QTLGERFLRNRG
       OsABCT(CAD59574) (716) IRGRARRMMRSQQAISINEFLASRWAIPNTDATID-EPTVGKAILKSKG
```

FIGURE 37D

```
ZmABCT(partial, Mo17)   (803)  ----------------------------------------
       ZmABCT(Composite)   (836)  IFVDKNWYWIGAAGLLGFTIFFNVLFTLSLMYLNPIG---------KPQA
         OsABCT(BAD53545)  (776)  IFTDKNWFWIGAAGLLGFTMFFNVLFTLSLVYLNPIG---------KPQA
         OsABCP(NP_916719) (784)  VFTNKEWYWIATGALLGFTILFNVLFSLSLMYLNPVG---------KPQS
         AtABCT(AAD39329)  (763)  VYHQKNWYWISVGALLCFTALFNILFTLALTYLNP-----------LGKKAG
         AtABCT(DAA00875)  (760)  VFDDKNWYWIGVGGLLGFTVIFNGFFTLALTYLDP-----------LGKAQA
         AtABCT(AAD39650)  (760)  VFDDKNWYWIGVGGLLGFTVIFNGFFTLALTYLDLTYMCIMTTALGKAQA
         AtABCT(BAB01273)  (738)  IFTDPNWYWIGVGGILGFTVLFNILVTLALTELNPIE---------KQQA
         OsABCT(XP_464576) (745)  IFVDANWYWIGVGALLGXILLFNILFILFLEWLDPIG---------KGQA
         SpABCT(CAA94437)  (747)  IFVDKNWYWIGVGALIGAMVLFNFLFILFLEWLDPIG---------KGQT
         OsABCT(CAD59574)  (765)  LITSDGGFWISIGALIGFLVVFNILYILALTYLSPGG---------SSIT ZmABCT(partial, Mo17)   (803)  ----------------------------------------
       ZmABCT(Composite)   (877)  VISEETAKEAEGNGHSKGAIRNGSTKPKDGSHNSLVISEEMKEMRLSACL
         OsABCT(BAD53545)  (817)  VISEETAKEAEGNGDARHTVRNGSTKSNG------GNHKEMREMRLSARL
         OsABCP(NP_916719) (825)  ILPEETDSQENIQEGKNKAHIKQIITVETPEPVSPNSIITLDKVIQQLRG
         AtABCT(AAD39329)  (804)  LLPEEENEDADQGKDPMRRSLSTADGNRR---------------GEV
         AtABCT(DAA00875)  (801)  ILPKEEDEEAKGKAG---------------------------------
         AtABCT(AAD39650)  (810)  ILPKEEDEEAKGKAG---------------------------------
         AtABCT(BAB01273)  (779)  VVSKENTEENRAENG---------------------------------
         OsABCT(XP_464576) (786)  VVSEEELREKHVNRTGEN------------------VELLTLGTD
         SpABCT(CAA94437)  (788)  TVSEEALQEKEANRTGAN------------------VELATRGSA
         OsABCT(CAD59574)  (806)  IXSDEDSEQKTDMKTRNEQ---QM------------SQIVHNNGA ZmABCT(partial, Mo17)   (803)  ----------------------------------------
       ZmABCT(Composite)   (927)  SNCSSNGVSRLMSIGSNEAAPIRGMVLPFNPLAMSFDNVNYXVDMPAEMK
         OsABCT(BAD53545)  (861)  SNSSSNGVSRLMSIGSNEAGPRRGMVLPFTPLQMSFDDVNYXVDMPAEMK
         OsABCP(NP_916719) (875)  YSANTSDRSHSYINAAGRTAPGRGMVLPFFEPLYMSFREINYXVDMPLEMK
         AtABCT(AAD39329)  (836)  AMGRMS--RDSAAEASGGAGNKRGMVLPFTPLAMSFDDVKYFVDMPGEMR
         AtABCT(DAA00875)  (816)  ---------SNKETEMESVSAKKGMVLPFTPLAMSFDDVKYFVDMPAEMR
         AtABCT(AAD39650)  (825)  ---------SNKETEMESVSAKKGMVLPFTPLAMSFDDVKYFVDMPAEMR
         AtABCT(BAB01273)  (794)  ------------SKSKSIDVKRGMVLPFTPLTMSFDNVNYXVDMPKEMK
         OsABCT(XP_464576) (813)  SQNSPSDANAGRGEISGADTRKRGMVLPFTPLSITFDNIRYSVDMPQEMK
         SpABCT(CAA94437)  (815)  ATSDG-----GSVEIRKDGNRKRGMVLPFTPLSITFDNVKYSVDMPQEMK
         OsABCT(CAD59574)  (836)  SNTSATSSIPMSGSRSTNQQSRSQIVLPFQPLSLCFNHVNYXVDMPTEMK ZmABCT(partial, Mo17)   (803)  ----------------------------------------
       ZmABCT(Composite)   (977)  HQGVQDDRLQLLREVTGSFRPGVLTALMGVSGAGKTTLMDVLAGRKTGGY
         OsABCT(BAD53545)  (911)  QQGVVDDRLQLLRDVTGSFRPAVLTALMGVSGAGKTTLMDVLSGRKTGGY
         OsABCP(NP_916719) (925)  SQGVTADKLQLLSGISGAFRPGVLTALMGVSGAGKTTLMDVLSGRKTGGY
         AtABCT(AAD39329)  (884)  DQGVIETRLQLLKGVTGAFRPGVLTALMGVSGAGKTTLMDVLAGRKTGGY
         AtABCT(DAA00875)  (857)  EQGVQETRLQLLKGVTSAFRPGVLTALMGVSGAGKTTLMDVLAGRKTGGY
         AtABCT(AAD39650)  (866)  EQGVQETRLQLLKGVTSAFRPGVLTALMGVSGAGKTTLMDVLAGRKTGGY
         AtABCT(BAB01273)  (831)  EQGVSKDKLQLLKEVTGVFRPGVLTALMGVSGAGKTTLMDVLAGRKTGGY
         OsABCT(XP_464576) (863)  DRGVIEDRLLLLKGVSGAFRPGVLTALMGVSGAGKTTLMDVLAGRKTGGY
         SpABCT(CAA94437)  (860)  DRGVTEDKLLLLKGVSGAFRPGVLTALMGVSGRGKTTLMDVLAGRKTGGY
         OsABCT(CAD59574)  (886)  EQGFIESRLQLLSDISGVFRPGVLTALXGVSGAGKTTLMDVLAGRKTSGV
```

FIGURE 37E

```
ZmABCT(partial, Mo17)   (803)  ----------------------------------------------------
     ZmABCT(Composite)  (1027) IEGDIRISGYPKNQATFARISGYCEQNDIHSPQVTVRESLIYSAFLRLPG
      OsABCT(BAD53545)  (961)  IEGDMRISGYPKNQETFARISGYCEQNDIHSPQVTVRESLIYSAFLRLPE
      OsABCP(NP_916719) (975)  IEGEIYISGYPKNQATFARISGYCEQNDIHSPQITVRESLIFSAFLRLPK
      AtABCT(AAD39329)  (934)  IEGDVRISGFPKVQETFARISGYCEQTDIHSPQVTVRESLIFSAFLRLPK
      AtABCT(DAA00875)  (907)  IEGDVRVSGFPKKQETFARISGYCEQTDIHSPQVTVRESLIFSAFLRLAK
      AtABCT(AAD39650)  (916)  IEGDVRVSGFPKKQETFARISGYCEQTDIHSPQVTVRESLIFSAFLRLAK
      AtABCT(BAB01273)  (881)  IEGDIRISGFPKRQETFARISGYCEQNDIHSPQVTVRESLIYSAFLRLPK
      OsABCT(XP_464576) (913)  IEGDISISGYPKKQETFARIAGYCEQNDIHSPRVTVYESLLYSAWLRLPS
      SpABCT(CAA94437)  (910)  IEGDIRISGYPKNQETFARISGYCEQNDIHSPRVTVYESLLYSAWLRLPA
      OsABCT(CAD59574)  (936)  IEGDITLSGYPKKQETFARISGYCEQTDIHSPRVTVYESILYSAWLRLSS ZmABCT(partial, Mo17)   (803)  ----------------------------------------------------
     ZmABCT(Composite)  (1077) KIGDQEITDDIKMQFVDEVMELVELDNLRDALVGLPGITGLSTEQRKRLT
      OsABCT(BAD53545)  (1011) KIGDQEITDDIKIQFVDEVMELVELDNLKDALVGLPGITGLSTEQRKRLT
      OsABCP(NP_916719) (1025) EVNDQEK---K--IFVDEVMELVELTGLKDAVVGLPGVNGLSTEQRKRLT
      AtABCT(AAD39329)  (984)  EVGKDEK-----MMFVDQVMELVELDSLRDSIVGLPGVTGLSTEQRKRLT
      AtABCT(DAA00875)  (957)  EVSKEDK-----LMFVDQVMELVELVDLRDAIVGLPGVTGLSTEQRKRLT
      AtABCT(AAD39650)  (966)  EVSKEDK-----LMFVDQVMELVELVDLRDAIVGLPGVTGLSTEQRKRLT
      AtABCT(BAB01273)  (931)  EVTKYEK-----MRFVDEVMELVELESLKDAVVGLPGITGLSTEQRKRLT
      OsABCT(XP_464576) (963)  EVDSEAR-----KMFVEEVMELVELTSLRGAIVGLPGVNGLSTEQRKRLT
      SpABCT(CAA94437)  (960)  EVDEKQR-----KMFVDEVMDLVELNSLRGSLVGLPGVTGLSTEQRKRLT
      OsABCT(CAD59574)  (986)  DVDTNTK-----KMFVDEVMSLVELDVLRNALVGLPGVSGLSTEQRKRLT ZmABCT(partial, Mo17)   (803)  ----------------------------------------------------
     ZmABCT(Composite)  (1127) IAVELVANPSIIFMDEPTSGLDARAAAIVMRTVRNTVDTGRTVVCTIHQP
      OsABCT(BAD53545)  (1061) IAVELVANPSIIFMDEPTSGLDARAAAIVMRTVRNTVDTGRTVVCTIHQP
      OsABCP(NP_916719) (1070) IAVELVANPSIIFMDEPTSGLDARAAAIVMRTVRNTVNTGRTVVCTIHQP
      AtABCT(AAD39329)  (1029) IAVELVANPSIIFMDEPTSGLDARAAAIVMRAVRNTVDTGRTVVCTIHQP
      AtABCT(DAA00875)  (1002) IAVELVANPSIIFMDEPTSGLDARAAAIVMRAVRNTVDTGRTVVCTIHQP
      AtABCT(AAD39650)  (1011) IAVELVANPSIIFMDEPTSGLDARAAAIVMRAVRNTVDTGRTVVCTIHQP
      AtABCT(BAB01273)  (976)  IAVELVANPSIIFMDEPTSGLDARAAAIVMRTVRNTVDTGRTVVCTIHQP
      OsABCT(XP_464576) (1008) IAVELVANPSIIFMDEPTSGLDARAAAIVMRTVRNTVDTGRTVVCTIHQP
      SpABCT(CAA94437)  (1005) IAVELVANPSIIFMDEPTSGLDARAAAIVMRAVRNTVDTGRTVVCTIHQP
      OsABCT(CAD59574)  (1031) IAVELVANPSVIFMDEPTSGLDARAAAIVMRTVRNTVNTGRTVVCTIHQP ZmABCT(partial, Mo17)   (803)  ----------------------------------------------------
     ZmABCT(Composite)  (1177) SIDIFESFDELLLIKRGGQVIYSGKLGRNSQKMVEYFEAIPGVPKIKDKY
      OsABCT(BAD53545)  (1111) SIDIFEAFDELLLIKRGGQVIYGQLGRNSQKMIEYFEAIPGVPKIKDKY
      OsABCP(NP_916719) (1120) SIDIFEAFDELLLLKRGGQVIYGPLGTNSHKVVEYFEAIPGVPKIEENR
      AtABCT(AAD39329)  (1079) SIDIFEAFDELMLMKRGGQVIYGPLGQNSHKVVEYFESFPGVSKIPEKY
      AtABCT(DAA00875)  (1052) SIDIFEAFDELLLIKRGGHVIYGPLGRNSHKVVEYFESFPGVPKIPEKY
      AtABCT(AAD39650)  (1061) SIDIFEAFDELLLMKRGGQVIYGPLGRNSHKVVEYFESFPGVPKIPEKY
      AtABCT(BAB01273)  (1026) SIDIFEAFDELLLIKRGGQVIYGPLGQNSHKIIEYFQAIHGVPKIKEKY
      OsABCT(XP_464576) (1058) SIDIFEAFDELFLIKRGGEEIYVGPLGHNSCHLINYFEGIQGVRKIKDGY
      SpABCT(CAA94437)  (1055) SIDIFEAFDELFLMKRGGEEIYVGPLGRQSSHLIKYFESIDGVKKIKERY
      OsABCT(CAD59574)  (1081) SIDIFESFDELLLIKRGGQVIYAGELGRHSHKVVEYFEAIPGVPKITEGY
```

FIGURE 37F

```
ZmABCT(partial, Mo17)   (803)  ------------------------------------------------------
    ZmABCT(Composite)  (1227)  NPATWMLEVSSVATEVRLKMDFAKYYETSDLYKQNKVLVNQLSQPEPGTS
     OsABCT(BAD53545)  (1161)  NPATWMLEVSSVAAEVRLNMDFAEYYKTSDLYKQNKVLVNQLSQPEPGTS
     OsABCP(NP_916719) (1170)  NPATWMLDVSSAASEVRLEIDFAEYYRSSTMHQRTKALVKELSNPPPGSD
     AtABCT(AAD39329)  (1129)  NPATWMLEASSIAAELKLSVDFAELYNQSALHQRNKALVKELSVPPAGAS
     AtABCT(DAA00875)  (1102)  NPATWMLEASSIAAELKLGVDFAELYKASALCQRNKALVQELSVPPQGAT
     AtABCT(AAD39650)  (1111)  NPATWMLEASSIAAELKLGVDFAELYKASALCQRNKALVQELSVPPQGAT
     AtABCT(BAB01273)  (1076)  NPATWMLEVSSMAAEAKLEIDFAEHYKTSSLYQQNKNLVKELSTPPQGAS
     OsABCT(XP_464576) (1108)  NPATWMLEVTTIAQEDILGINFAEVYRNSDLYQRNKTLISELSTPPPGST
     SpABCT(CAA94437)  (1105)  NPATWMLEVTTISQEEILGINFAEVYRNSDLYKRNKDLIKELSTPPPGSK
     OsABCT(CAD59574)  (1131)  NPATWMLEVTSPIAEARLNVNFAELYANSELYRKNQELIKELSTPPPGYQ ZmABCT(partial, Mo17)   (803)  ------------------------------------------------------
    ZmABCT(Composite)  (1277)  DLYFPTEYSQSTIGQFKACLWKQWLTYWRSPDYNLVRYSFTLLVALILGS
     OsABCT(BAD53545)  (1211)  DLHFPTKYSQSTIGQFRACLWKQWLTYWRSPDYNLVRFSFTLFTALLLGT
     OsABCP(NP_916719) (1220)  DLYFPSQYSQSTFNQFKLCLWKQWWTYWRSPDYNLVRIFFALFTALMLGT
     AtABCT(AAD39329)  (1179)  DLYFATQFSQNTWGQFKSCLWKQWWTYWRSPDYNLVREIFTLATSLLIGT
     AtABCT(DAA00875)  (1152)  DLYFATQFSQNTWGQFKSCLWKQWWTYWRSPDYNLVREIFTLATSLMIGS
     AtABCT(AAD39650)  (1161)  DLYFATQFSQNTWGQFKSCLWKQWWTYWRSPDYNLVREIFTLATSLMIGS
     AtABCT(BAB01273)  (1126)  DLYFSTRFSQSLLGQFKSCLWKQWITYWRTPDYNLARFFFTLAAAVMLGS
     OsABCT(XP_464576) (1158)  DLHFPTQFSQPFFTQCMACLWKQHKSYWRNPSYTATRIFFTTVIALIFGT
     SpABCT(CAA94437)  (1155)  DLFFATQFSQSFVMQCLACLWKQHKSYWRNPSYTATRLFFTYVIALIFGT
     OsABCT(CAD59574)  (1181)  DLSFPTKYSQNFYSQCIANFWKQKRSYWKNPPYNAMRYLMTLLNGLVFGT ZmABCT(partial, Mo17)   (803)  ------------------------------------------------------
    ZmABCT(Composite)  (1327)  IFWREGTNMEDATTLGMVIGAMYTAVMFIGINNCSTVQPYVSIERTVFYR
     OsABCT(BAD53545)  (1261)  IFWKEGTKMGNANSLRMVIGAMYTAVMFIGINNCATVQPLVSIERTVFYR
     OsABCP(NP_916719) (1270)  IFWRVGHKMESSKDLLVIIGSMYAAVLFVGFENSVTVQPYVAVERTVFYR
     AtABCT(AAD39329)  (1229)  VFWQEGGNRSNAGDLTMVIGALYAALIFVGINNCSTVQPMVAVERTVFYR
     AtABCT(DAA00875)  (1202)  VFWQEGGKRSNVQDLTMVIGALYAAVFVGINNCSTVQPMVAVERTVFYR
     AtABCT(AAD39650)  (1211)  VFWQEGGKRSNVQDLTMVIGALYAAVFVGINNCSTVQPMVAVERTVFYR
     AtABCT(BAB01273)  (1176)  IFWKVGTKRENANDLTKVIGAMYAAVLFVGVNNSSSVQPLIAVERSVFYR
     OsABCT(XP_464576) (1208)  IFLNLGKKINKRLDLFNSLGSMYAAVLFGIQNGQTVQPIVDVERTVFYR
     SpABCT(CAA94437)  (1205)  IFWDLGKKRSTSLDLINAMGSMYAAVIFGIQNAQTVQPIVDVERTVFYR
     OsABCT(CAD59574)  (1231)  IFWQKGTKISSQQDLFNLLGATYAATFFLGAANCITVQPYVSIERTVFYR ZmABCT(partial, Mo17)   (803)  ------------------------------------------------------
    ZmABCT(Composite)  (1377)  ERAAGMYSAMPYAIAQVVIEIPYVFQTTYYILIVYAMMSFQWTAVKFFW
     OsABCT(BAD53545)  (1311)  ERAAGMYSAMPYAIAQVVMEIPYVFQTAYYTLIVYAMMSFQWTAAKFFW
     OsABCP(NP_916719) (1320)  ERAAGMYSAIPYALAQVVVEIPYVFETVIYTLIVYPMMSFQWTPAKFFW
     AtABCT(AAD39329)  (1279)  ERAAGMYSAMPYAISQVTCELPYVLIQTVYYSLIVYAMVGFEWKAEKFFW
     AtABCT(DAA00875)  (1252)  EKAAGMYSAIPYAISQVTCELPYVLIQTTYYSLIIYSMVGFEWKASKFLW
     AtABCT(AAD39650)  (1261)  EKAAGMYSAIPYAISQVTCELPYVLIQTTYYSLIIYSMVGFEWKASKFLW
     AtABCT(BAB01273)  (1226)  ERAAEMYSALPYAIAQVVCELPYVLIQTTYYTLIIYAMMCFEWTLAKFFW
     OsABCT(XP_464576) (1258)  EKAAGMYSAIPYAFAQVLIEIPHIPLQTVVYGLIVYSIIGFEDWTVEKFFW
     SpABCT(CAA94437)  (1255)  EKAAGMYSAIPYAYAQVLIEVPHILVQTLLYGLVYSMIGFDWTAAKFLW
     OsABCT(CAD59574)  (1281)  ERAAGMYSSLCYAFAQACVEVIYNLLQGILYTIIIYAMIGYDWKADKFFY
```

FIGURE 37G

```
ZmABCT(partial, Mo17)  (803)   ----------------------------------------
    ZmABCT(Composite)  (1427)  FFFISYFSFLYFTYYGMMAVSISPNHEVASIFAAAFFSLFNLFSGFFIPR
     OsABCT(BAD53545)  (1361)  FFFVSYFSFLYFTYYGMMTVAISPNHEVAAIFAAAFYSLFNLFSGFFIPR
     OsABCP(NP_916719) (1370)  FFYVSFFSFLYFTYYGMMNVSVSPNLQVASILGAAFYTLFNLFSGFFIPR
     AtABCT(AAD39329)  (1329)  FVFVSYFSFLYWTYYGMMTVSLTPNQQVASIFASAFYGIFNLFSGFFIPR
     AtABCT(DAA00875)  (1302)  FIFINYFSFLYWTYYGMMTVSLTPNQQVASIFASAFYGIFNLFSGFFIPR
     AtABCT(AAD39650)  (1311)  FIFINYFSFLYWTYYGMMTVSLTPNQQVASIFASAFYGIFNLFSGFFIPR
     AtABCT(BAB01273)  (1276)  FYFVSFMSFLYFTYYGMMTVALTPNQQVAAYFAGAFYGLFNLFSGFVIPR
     OsABCT(XP_464576) (1308)  YMFFMFFFFNYFTEYGMMAVAMTPNSDIAAIVSTAFYCIWNIFAGFLIPR
     SpABCT(CAA94437)  (1305)  YMFFMFFFFLYFTYYGMMAVAMTPNSDIAAIVAAAFYAIWNIFAGFIIPR
     OsABCT(CAD59574)  (1331)  FMFFIVASFNYFTLEGMMLVACTPSAMLANILISFVLPLWNLFAGFLVVR ZmABCT(partial, Mo17)  (803)   ----------------------------------------
    ZmABCT(Composite)  (1477)  PRIPGWWFWYYWICPLAWTYYGLIVTQYGDLEDLISVPGES-EQTFSYYY
     OsABCT(BAD53545)  (1411)  PRIPKWWFWYYWLCPLAWTYYGLIVTQYGDLEQIISVPGQS-NQTFSYYY
     OsABCP(NP_916719) (1420)  PKIPKWWVWYYWICPVAWTYYGLIVSQYGDVEDFITVPGQS-DQQVRPFI
     AtABCT(AAD39329)  (1379)  PKIPKWWFWYYWICPVAWTVYGLIVSQYGDVETRIQVLGGAPDLTVKQYI
     AtABCT(DAA00875)  (1352)  PKIPKWWVWYYWICPVAWTIYGLITSQYGDVETPIALLGGAPGLTVKQYI
     AtABCT(AAD39650)  (1361)  PKIPKWWVWYYWICPVAWTIYGLITSQYGDVETPIALLGGAPGLTVKQYI
     AtABCT(BAB01273)  (1326)  PRIPKWWFWYYWICPVAWTVYGLIVSQYGDVEDTIKVPGMANDPTFKWYI
     OsABCT(XP_464576) (1358)  PRIPIWWRWYSWACPVAWTIYGLVASQYG---DITNSTLED-GEVVQDYI
     SpABCT(CAA94437)  (1355)  PRIPIWWRWYYWACPVAWTIYGLVVSQFG---EYTDIMSDV-DETVKDFF
     OsABCT(CAD59574)  (1381)  PLIPIWWRWYYWANPVFWTIYGVVASQFGKNGDVISVPGGS-PTVVKQFF ZmABCT(partial, Mo17)  (803)   ----------------------------------------
    ZmABCT(Composite)  (1526)  THHFGYHRDFLPVFAPVLVLFAVFFAFIYAVCIKKLNFQQR
     OsABCT(BAD53545)  (1460)  THHECYHRKFMPVVAPVLVLFAVFFAFMMAICIKKLNFQHR
     OsABCP(NP_916719) (1469)  KDYFGYDPDFMGVVAAVLAGFTVFFAFTYAYSIRTLNFQQR
     AtABCT(AAD39329)  (1429)  EDHYGFQSDFMGPVAAVLIAFTVFFAFIFAFCIRTLNFQTR
     AtABCT(DAA00875)  (1402)  KDQYGFESDYMGPVAGVLVGFTVFFAFIFAFCIKTLNFQSR
     AtABCT(AAD39650)  (1411)  KDQYGFESDYMGPVAGVLVGFTVFFAFIFAFCIKTLNFQSR
     AtABCT(BAB01273)  (1376)  ENHYGYDADFMIPFATVLVGFTIFFAFMFAFGIRTLNFQQR
     OsABCT(XP_464576) (1404)  RRYFGFRHDYLGYVATAYVGFAALFAFVFAFSIKVFNFQRR
     SpABCT(CAA94437)  (1401)  RRFLGFRHDFLPVVGVMYVVFTVLFASIFAFSIKTLNFQRR
     OsABCT(CAD59574)  (1430)  EDNLGMRHSFLGYVVLTHFGYIIVFFFIFGYAIKYFNFQKR
```

FIGURE 37H

```
                              1                                                  50
AtNF-YB-6 (LEC1-like)    (1)  -------MERGGFHGYRKLSVNNTTPS PGLAANFLM EGSMRPPEFNQP
      AtNF-YB-9(LEC1)    (1)  MERGAPFSHYQLPKSISELNLDQHSNN TPMTSSVVV GAGDK-------
               OsLEC1    (1)  -----------------------MEAGYPGTAAN A DG----------
               Zm_LEC1   (1)  --------------------MDSSSFL AAGAEN S GGAN--------
           Zm_LEC1-like  (1)  --------------------MDSSFL AG-ADN S GANN--------
              ZmHAP3-2   (1)  ------------MNNPQNPKASAPCTL PELPKE V TDEAPPPMG---
          Soybean LEC1   (1)  --------------------MRQQQVASSDQNCSNHS GEE-------
             wheat LEC1  (1)  -------------------MENDGV NGPAAP PTQGTP--------
              AtNF-YB-4  (1)  --------------------------------------------------
              AtNF-YB-5  (1)  ----------------MAGNYHSFQN IPRYQNYNF SSSSNHQHEHDG
             Zm_HAP3L6   (1)  ------------------MADHHHHHHHGHPPD PG AGD---------
             Zm_HAP3L9   (1)  -----------------------MAAGHHGQPPD ED RRA--------
             Zm_HAP3L2   (1)  -----------MSHTSNFTGFSQLEH QPQRNSRASSSTTH-------
             OsHAP3L6    (1)  --------------MADHHGGHHADGHRRQQQLQ E DQAA-------
             OsHAP3L9    (1)  ------------MQGLPRASSSSTSASRDRDGGD DG GGGV------
             Consensus   (1)                                P       G  AA 51                                                 100
AtNF-YB-6 (LEC1-like)   (44)  NKTSNGGEEE--C-T
      AtNF-YB-9(LEC1)   (44)  -N-NGIVVQQQPPC
               OsLEC1   (18)  ---NGGAQQAAAAPA
              Zm_LEC1   (23)  ---NGGAAQQHAAPA
           Zm_LEC1-like (21)  ---GGGAAQQ--APP
              ZmHAP3-2  (35)  ---NNNNTESATAT
          Soybean LEC1  (23)  -------N----ECT
             wheat LEC1 (21)  ---------------
             AtNF-YB-4   (1)  ---------------
             AtNF-YB-5  (34)  LVVVVEDQQQEESM
            Zm_HAP3L6   (23)  --------Q---LE
            Zm_HAP3L9   (19)  -------------V
            Zm_HAP3L2   (31)  ------------DAN
            OsHAP3L6    (29)  ------------AE
            OsHAP3L9    (31)  ------------T
            Consensus   (51)                  VVREQDRLMPIANV RIMR ILPAHAKISDDAKETI A domain            B domain 101                                                                              150
AtNF-YB-6 (LEC1-like)   (91)                                                   TL
      AtNF-YB-9(LEC1)   (92)                                                   TV
              OsLEC1    (65)                                                   GV
              Zm_LEC1   (70)                                                   GA
          Zm_LEC1-like  (66)                                                   SV
             ZmHAP3-2   (82)                                                   GA
         Soybean LEC1   (62)                                                   TM
            wheat LEC1  (57)                                                   SV
             AtNF-YB-4  (36)                                                   GR
             AtNF-YB-5  (84)                                                   KK
            Zm_HAP3L6   (62)                                                   RR
            Zm_HAP3L9   (56)                                                   RG
            Zm_HAP3L2   (69)                                                   RR
            OsHAP3L6    (67)                                                   RR
            OsHAP3L9    (68)                                                   HR
            Consensus  (101)  QECVSEFISFVTGEANERC RE RKTVNAEDVLWAMSRLGFDDYVDPL
```

FIGURE 38A

```
                           151                                            200
AtNF-YB-6 (LEC1-like)  (141) ░░░░░L░-----░VSC░░G-----------------------
    AtNF-YB-9(LEC1)    (142) ░░░░░I░T░----░SALR░E-----------------------
             OsLEC1    (115) ░░░░░F░░S----░VGV░VG--AARGDHHHGH----VGGMLKSRA
             Zm_LEC1   (120) ░░░░░F░░A----░VGL░PGAAPSRGGDHHPHSMSPAAMLK-SRG
         Zm_LEC1-like  (116) ░░░░░F░░A----░VGL░P--APPRGDHHHHHHSVPPSMLNKSRG
            ZmHAP3-2   (132) ░░░M░DSD░GG-EE-░░GPA░RG-------GSRRG----SSSLPHCP
         Soybean LEC1  (112) ░░░░L░░RT-SM-░EPL░KR-----------------------
           wheat LEC1  (107) ░░░M░P░░GTGGAA-A░DSR░VTSAPPRAAPPVIHAVPLQAQRPMYAP
             AtNF-YB-4 (86)  ░░░░░A░R░RTEHN-░SND░░N-----------------------
             AtNF-YB-5 (134) ░░░░VL░░KPNHHG░░GPKSSPDN---------------------
             Zm_HAP3L6 (112) ░░░░░L░░RAASSRG░GGGP░G-----------------------
             Zm_HAP3L9 (106) ░░░░░░V░RAAAASSRG░D------------------------
             Zm_HAP3L2 (119) ░░░░T░ELAAALNSG░GGHD░S-----------------------
             OsHAP3L6  (117) ░░░░L░░RAAAATSRSG░A-----------------------
             OsHAP3L9  (118) ░░░░░G░ELAASLNSSSSAA░A-----------------------
            Consensus  (151) YLHRYRE EGD     RG   AG C domain 201                                            250
AtNF-YB-6 (LEC1-like)  (160) -----------S-------V░MTN░LV░KR░-----------NGTMT
    AtNF-YB-9(LEC1)    (161) -----------------LRQTYG░NG░GFH---------------GPS
             OsLEC1    (154) QGS-------MVTHHDMQMHA░MYG░GA░PP░--PHPPPHHHAFHQLMPP
             Zm_LEC1   (164) PVSGAAMLPHHHHHHDMQMHA░MYG░TA░PP░AGPPHHGGFLMPHPQGSS
         Zm_LEC1-like  (159) PGSGAVMLPHHHHHD---MHA░MYG░AVPPP░-----HHGFLMPHPQGG-
            ZmHAP3-2   (169) QQMHHLHPAVCRRPHQSVSPA░GYAVRP░PR░---------MPASGYRM
         Soybean LEC1  (135) ----------------TVEY░TLATAF░PP░---------------FHH
           wheat LEC1  (156) PAPLQVENQMQRPVYAPPAPV░VQMQRG░YG░RAPVHGYAVGMAPVRANV
             AtNF-YB-4 (110) ----------------EKETNTRSD░QNQ-------------STKFI
             AtNF-YB-5 (161) -----------------------------------------
             Zm_HAP3L6 (137) ----------------AADP░SAS░AAGPS░-----------SAASAG
             Zm_HAP3L9 (131) ----------------HHP░SAS░STSPAA-----------AAAPGH
             Zm_HAP3L2 (144) ----------AIQIDVRDEL░IFK░SNQQGGRD----------------
             OsHAP3L6  (142) ------------AAG-PDHP░SSS░AAAATA-----------GHFMFN
             OsHAP3L9  (143) -----------------AAAGSRG░GA░QID-----------VRAELS
            Consensus  (201)                      A    G   V  P 251                                            300
AtNF-YB-6 (LEC1-like)  (178) EYGAYGPVPGIHMAQYHYRH--QNGFVFSGNEP-----NSKMSGSS----
    AtNF-YB-9(LEC1)    (180) HGLPPPGPYGYGMLDQSMVMG--GGRYYQNGSS-----GQDESSVG----
             OsLEC1    (195) HHGQYAPPYDMYGGEHGMAA--YYGGMYAPGS------GGDGSGSS----
             Zm_LEC1   (214) HYLPYAYEPT-YGGEHAMAA--YYGGAAYAPGN------GGSGDGSGSGGG
         Zm_LEC1-like  (200) HYLPYPYEPTSYGGEHALASGYYGGAAYAPGNN------GGSGDGSG----
            ZmHAP3-2   (209) QGGDHRSVGGVAPCSYGGALVQAGGTQHVVGFH-----DDEASSSS----
         Soybean LEC1  (153) HNGYFGAAMPMGTYVRETPPNAASSHHHHGISN-----AHEPNARSI---
           wheat LEC1  (206) GGQYQVFGGEGVMAQQYYGYGYEEGAYGAGSSNGGAAIGDEESSSNGVPA
             AtNF-YB-4 (128) RVVEKGSSSSAR--------------------------------
             AtNF-YB-5 (161) -----------------------------------------
             Zm_HAP3L6 (158) HFMFGAAMDRPDNNSSAGARPF----------------------
             Zm_HAP3L9 (151) FMFGAAAIDRPDNNTSSARPF-----------------------
             Zm_HAP3L2 (167) --------------------------------------------
             OsHAP3L6  (166) AMDRSTDSSRQF--------------------------------
             OsHAP3L9  (163) IFRSGNNQGKKGVNSLFVEVKLN---------------------
            Consensus  (251)
```

FIGURE 38B

```
                                   301                       325
AtNF-YB-6 (LEC1-like)  (217)  --SGASGARVEVFPTQQHKY-----
     AtNF-YB-9(LEC1)   (219)  ---GGSSSSINGMPAFDHYGQYK--
              OsLEC1   (233)  -GSGGAGTPQT--VNFEHQHPFGYK
              Zm_LEC1  (256)  GGSASHTPQGS--GGLEHPHPFAYK
         Zm_LEC1-like  (241)  -GSASHAPPGGSGGGFDHPHTFAYK
             ZmHAP3-2  (250)  -----ENPPPEGRAAGSN-------
         Soybean LEC1  (195)  -------------------------
           wheat LEC1  (256)  PGEGMGEPEPEPAAEESHDKPVQSG
            AtNF-YB-4  (140)  -------------------------
            AtNF-YB-5  (161)  -------------------------
            Zm_HAP3L6  (180)  -------------------------
            Zm_HAP3L9  (172)  -------------------------
            Zm_HAP3L2  (167)  -------------------------
             OsHAP3L6  (178)  -------------------------
             OsHAP3L9  (186)  -------------------------
            Consensus  (301)
```

FIGURE 41A    FIGURE 41B
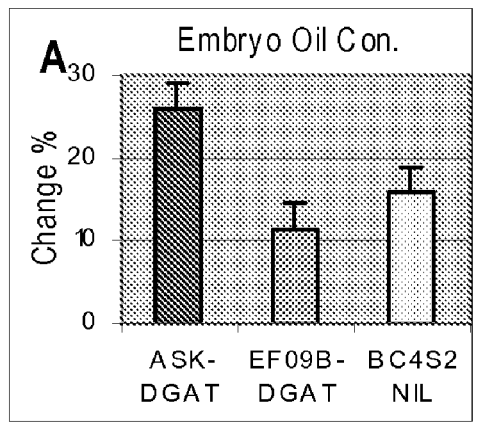
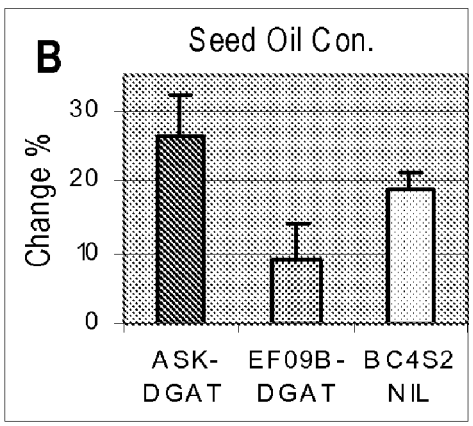
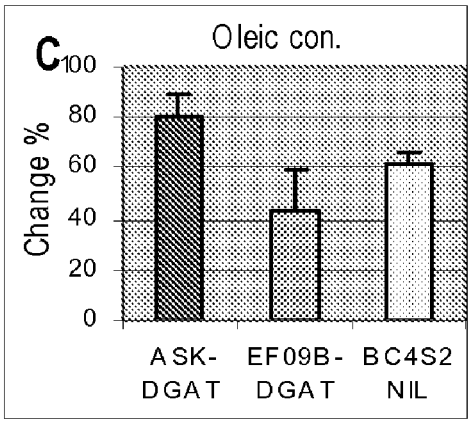
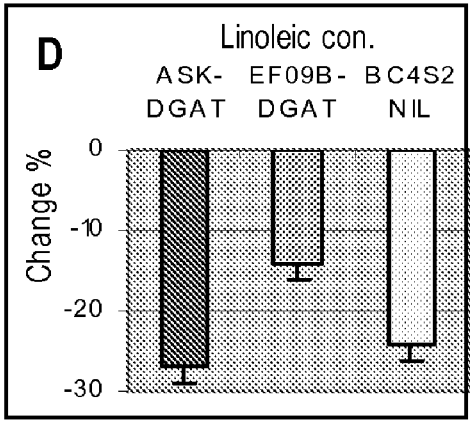
FIGURE 41C    FIGURE 41D

FIGURE 43A
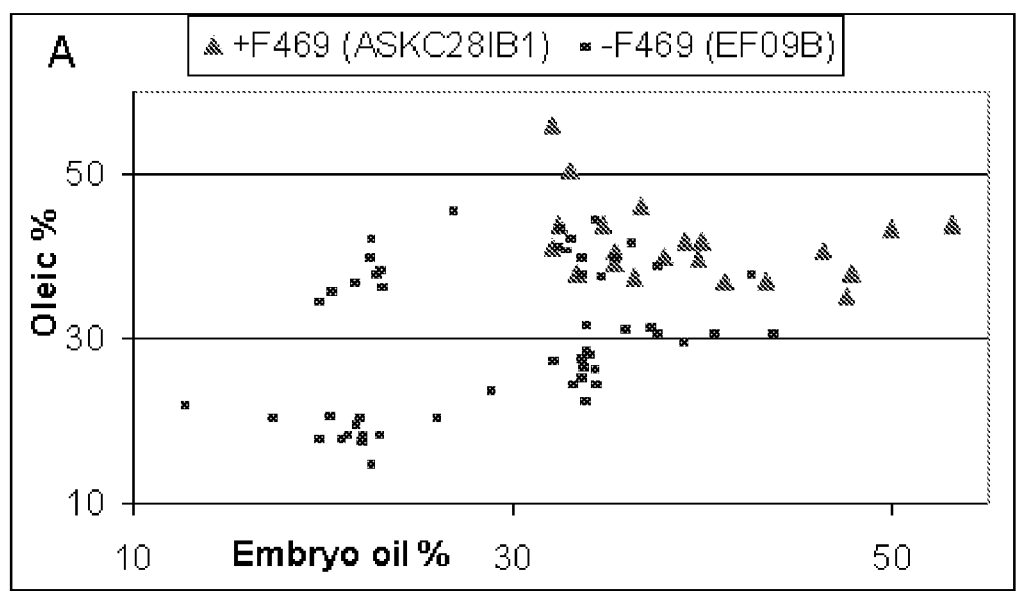
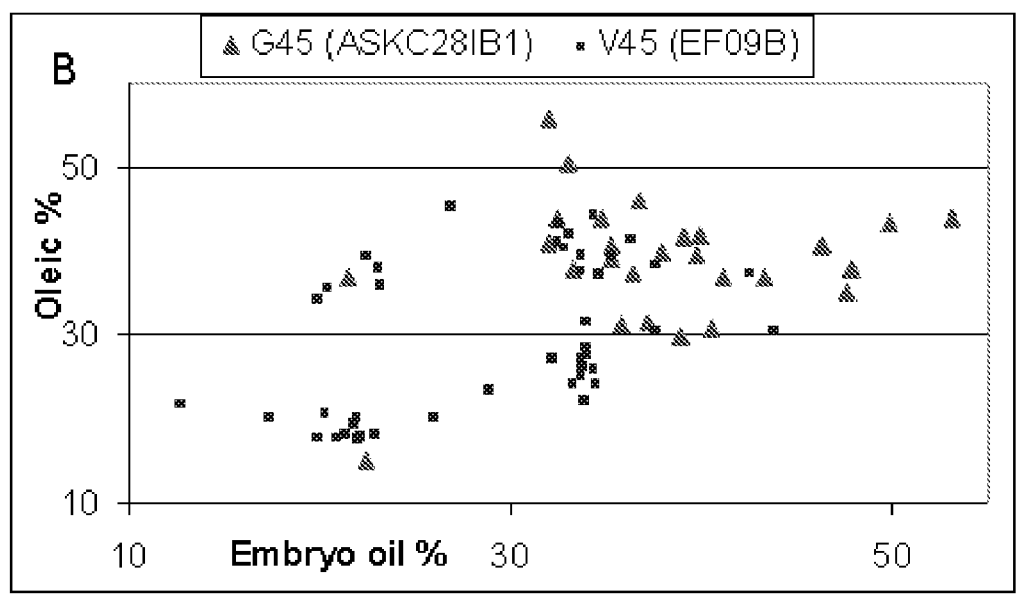
FIGURE 43B

COMPOSITIONS RELATED TO THE QUANTITATIVE TRAIT LOCUS 6 (QTL6) IN MAIZE AND METHODS OF USE

CROSS-REFERENCE TO RELATED APPLICATIONS

This application claims the benefit of U.S. Provisional Application No. 60/778,163, filed Mar. 1, 2006, the content of which is hereby incorporated herein in its entirety by reference.

REFERENCE TO SEQUENCE LISTING SUBMITTED ELECTRONICALLY

The official copy of the sequence listing is submitted electronically via EFS-Web as an ASCII formatted sequence listing with a file named 324368SequenceListing.txt, created on Mar. 1, 2007, and having a size of 653198 bytes and is filed concurrently with the specification. The sequence listing contained in this ASCII formatted document is part of the specification and is herein incorporated by reference in its entirety.

FIELD OF THE INVENTION

The invention relates to the field of plant breeding and genetic manipulation of plants, particularly for the modulation of oil content and oleic content in a plant or plant part.

BACKGROUND OF THE INVENTION

More than 50% of the maize grain crop produced in the USA is used for animal feed animal (Perry (1988) *Corn and Corn Improvement*, eds. Sprague and Dudley (Madison, Wis.), pp. 941-963). Maize grain with elevated oil concentration has a higher caloric content compared with standard maize grain and is advantageous as a food source for animals. Feeding high-oil maize grain instead of maize grain with standard levels of oil concentration to swine and poultry has resulted in accelerated weight gain (Han et al. (1987) *J. Poult. Sci.* 66:103-111 and Gross et al. (1992) *Proc. of the 47th Ann. Corn and Sorghum Res. Conference*, pp. 82-92). Thus, the development of high-oil germplasm is an objective of some maize breeding programs.

Molecular marker technology has enabled the association of DNA markers with important agronomic traits such as yield, plant height, disease resistance, etc. Methods and compositions that improve the oil content of plants and also provide novel molecular markers that allow for efficient breeding methods to identify high-oil plants are needed in the art.

BRIEF SUMMARY OF THE INVENTION

Compositions related to the quantitative trait locus 6 (QTL6) in maize and methods for their use are provided. The compositions are novel molecular marker loci that are genetically linked with QTL6 and which are associated with increased oil content and/or increased oleic acid content of a plant or plant part thereof, and/or an increased oleic acid/linoleic acid ratio within a plant or plant part thereof. These novel markers are characterized by the presence of at least one polymorphism relative to the corresponding marker locus from the QTL6 region of normal oil maize plants. In some embodiments, the novel marker loci comprise coding sequence for a polypeptide, wherein at least one polymorphism within the marker locus results in expression of a variant polypeptide that is associated with increased oil content, and/or increased oleic acid content, and/or an increased oleic acid/linoleic acid ratio within the plant or plant part thereof. In one such embodiment, the marker locus comprises a coding sequence for a maize DGAT1-2 or biologically active variant thereof, particularly the maize DGAT1-2(ASK) or biologically active variant thereof. The marker loci of the invention, and suitable fragments thereof, are useful in marker-assisted selection of a plant, for example, a maize plant, or plant part thereof, having an increased oil content, and/or increased oleic acid content, and/or an increased oleic acid/linoleic acid ratio, and for marker-assisted breeding of the high oil trait and/or high oleic acid trait, including increased oleic acid content and increased oleic acid/linoleic acid ratio.

In this manner, the present invention provides methods for identifying a maize plant or maize germplasm that has an increased oil content, an increased oleic acid content, and/or an increased oleic acid/linoleic acid ratio, the methods comprising detecting in the plant or germplasm at least one polymorphism within a marker locus of the invention that is associated with the increased oil content, the increased oleic acid content, or the increased oleic acid/linoleic acid ratio. In some embodiments, detection comprises the use of a detectably labeled probe comprising all or a portion of the marker locus or a complement thereof. Plants or germplasms identified as having the desirable high oil trait, and/or high oleic acid trait, and/or increased oleic acid/linoleic acid ratio trait can be selected for use in traditional breeding methods to introduce the desired trait into any suitable plant or germplasm of interest.

The present invention also provides methods for identifying the presence of a QTL6 locus that is associated with an increased oil content, an increased oleic acid content, and/or an increased oleic acid/linoleic acid ratio in a maize plant or maize germplasm. The methods comprise measuring the oleic acid concentration of seed of said maize plant or maize germplasm, wherein an oleic acid concentration of at least 35% is predictive that the maize plant or maize germplasm likely comprises this QTL6 locus. Plants or germplasms identified as having the desirable high oil/high oleic acid QTL6 locus can be selected for use in traditional breeding methods to introduce this desired locus into any suitable plant or germplasm of interest.

Compositions of the invention also comprise isolated polynucleotides for five open-reading frames within a maize QTL6 region disclosed herein and the polypeptides encoded thereby. The five open-reading frames encode a maize DGAT, designated ZmDGAT1-2(ASK), a maize amino acid permease 1, designated ZmAAP1; a maize potassium efflux system protein, designated ZmPESP, a maize 40S ribosomal protein S24, designated ZmS24, an a maize PDR-like ABC transporter, designated ZmABCT, and biologically active variants thereof. Also provided is the open-reading frame encoding the corresponding ZmDGAT1-2 from normal oil maize inbred lines and the polypeptide encoded thereby. Additionally, the invention provides isolated promoter sequences for the ZmDGAT1-2(ASK) gene, for a corresponding normal oil DGAT1-2 gene, designated ZmDAGT1-2(Mo17), and for the ZmAAP1, the ZmPESP(Mo17) and ZmPESP(ASK), the ZmS24, and the ZmABCT genes of the invention. These promoter sequences find use in driving expression of operably linked polynucleotides encoding polypeptides of interest, including the respective native polynucleotides encoding the ZmDGAT1-2(ASK), ZmDGAT1-2 (Mo17), ZmAAP1, ZmPESP, ZmS24, and ZmABCT polypeptides of the invention.

The compositions of the invention find use in manipulating oil, and/or oleic acid content, and/or oleic acid/linoleic acid ratio within a plant of interest or plant part thereof. In this manner, the present invention also provides expression cassettes comprising one or more of the polynucleotides of the invention, and transformed plant cells, plants, and seed comprising these expression cassettes. The expression cassettes find use in methods of the invention directed to increasing oil content, increasing oleic acid content, and/or increasing the oleic acid/linoleic acid ratio within a plant or plant part thereof.

BRIEF DESCRIPTION OF THE DRAWINGS

FIG. 3 provides data showing that QTL6 increases embryo and seed oil concentrations. On average, 10 kernels from each homozygous ear were analyzed for seed oil and embryo oil by NMR. For seed oil, air-dried kernels were used for direct NMR measurements. For embryo oil, kernels were soaked in water overnight. Embryos were dissected from endosperms, vacuum-dried and subjected to NMR analyses. QTL6 consistently increases embryo oil and seed oil concentrations at various generations.

FIG. 4 provides data showing that QTL6 also increases oil oleic/linoleic ratio in seeds. On average, five kernels from each homozygous ear were subjected to fatty acid profiling. Because greater than 80% of the total seed oil is from embryos, only whole seed were analyzed for fatty acids. Seeds were crushed and extracted with HPLC-grade hexanes. The hexane/oil extract is mixed 1/10 volume of trimethylsulfonium hydroxide in a gas chromatography GC vial. Fatty acid composition was determined by capillary GC in an Agilent model 6890 gas chromatograph with flame ionization detector and a split inlet. Fatty acid methyl esters were separated on a Zebron™ ZB-Wax capillary column. Data are expressed as normalized percent of all identified fatty acid methyl esters.

FIG. 5 provides data showing that oil QTL6 and Leafy Cotyledon 1 (LEC1) have additive effects on oil. Maize Leafy Cotyledon 1 (LEC1), a transcriptional activator containing B-domain, has been shown to increase embryo oil. An ASKC28IB1xEF09B BC2S2 line homozygous for QTL6 was crossed with homozygous plants containing maize LEC1 transgene. Embryo and seed oil from the resulting F1 seeds were analyzed by NMR. Data indicate that QTL6 and LEC1 have additive effects on embryo as well as seed oil concentrations.

FIG. 7 provides an alignment of the molecular marker QTL6 BAC05 developed from BAC end sequences of the three Mo17 BAC sequences covering the QTL6 region. The BAC05-ASK marker (SEQ ID NO:1) is aligned with the corresponding sequence from BAC05-EF09B (SEQ ID NO:2). The alignment also provides the forward primer (SEQ ID NO:68) and the reverse primer (SEQ ID NO:69) that can be used to amplify this marker.

FIG. 8 provides an alignment of the molecular marker QTL6 BAC17 developed from BAC end sequences of the three Mo17 BAC sequences covering the QTL6 region. The BAC17-ASK marker (SEQ ID NO:3) is aligned with the corresponding sequence from BAC17-EF09B (SEQ ID NO:4). The alignment also provides the forward primer (SEQ ID NO:70) and the reverse primer (SEQ ID NO:71) that can be used to amplify this marker.

FIG. 10 provides an alignment of the molecular marker QTL6 BAC20 developed from BAC end sequences of the three Mo17 BAC sequences covering the QTL6 region. The BAC20-ASK marker (SEQ ID NO:7) is aligned with the corresponding sequence from BAC20-EF09B (SEQ ID NO:8). The alignment also provides the forward primer (SEQ ID NO:74) and the reverse primer (SEQ ID NO:75) that can be used to amplify this marker.

FIG. 11 provides an alignment of the molecular marker QTL6 BAC22 developed from BAC end sequences of the three Mo17 BAC sequences covering the QTL6 region. The BAC22-ASK marker (SEQ ID NO:9) is aligned with the corresponding sequence from BAC22-EF09B (SEQ ID NO:10). The alignment also provides the forward primer (SEQ ID NO:76) and the reverse primer (SEQ ID NO:77) that can be used to amplify this marker.

FIG. 12 provides an alignment of the molecular marker QTL6 BAC24 developed from BAC end sequences of the three Mo17 BAC sequences covering the QTL6 region. The BAC24-ASK marker (SEQ ID NO:11) is aligned with the corresponding sequence from BAC24-EF09B (SEQ ID NO:12). The alignment also provides the forward primer (SEQ ID NO:78) and the reverse primer (SEQ ID NO:79) that can be used to amplify this marker.

FIG. 13 provides an alignment of the molecular marker QTL6 BAC29 developed from BAC end sequences of the three Mo17 BAC sequences covering the QTL6 region. The BAC29-ASK marker (SEQ ID NO:13) is aligned with the corresponding sequence from BAC29-EF09B (SEQ ID NO:14). The alignment also provides the forward primer (SEQ ID NO:80) and the reverse primer (SEQ ID NO:81) that can be used to amplify this marker.

FIG. 15 provides an alignment of the molecular marker QTL6SNP7 developed from BAC end sequences of the three Mo17 BAC sequences covering the QTL6 region. The QTL6SNP7-ASK marker (SEQ ID NO:17) is aligned with the corresponding sequence from QTL6SNP7-EF09B (SEQ ID NO:18). The alignment also provides the forward primer (SEQ ID NO:84) and the reverse primer (SEQ ID NO:85) that can be used to amplify this marker.

FIG. 16 provides an alignment of the molecular marker QTL6SNP8 developed from BAC end sequences of the three Mo17 BAC sequences covering the QTL6 region. The QTL6SNP8-ASK marker (SEQ ID NO:19) is aligned with the corresponding sequence from QTL6SNP8-EF09B (SEQ ID NO:20). The alignment also provides the forward primer (SEQ ID NO:86) and the reverse primer (SEQ ID NO:87) that can be used to amplify this marker.

FIG. 17 provides an alignment of the molecular marker QTL6SNP9 developed from BAC end sequences of the three Mo17 BAC sequences covering the QTL6 region. The QTL6SNP9-ASK marker (SEQ ID NO:21) is aligned with the corresponding sequence from QTL6SNP9-EF09B (SEQ ID NO:22). The alignment also provides the forward primer (SEQ ID NO:88) and the reverse primer (SEQ ID NO:89) that can be used to amplify this marker.

FIG. 18 provides an alignment of the molecular marker QTL6SNP13 developed from BAC end sequences of the three Mo17 BAC sequences covering the QTL6 region. The QTL6SNP13-ASK marker (SEQ ID NO:23) is aligned with the corresponding sequence from QTL6SNP13-EF09B (SEQ ID NO:24). The alignment also provides the forward primer (SEQ ID NO:90) and the reverse primer (SEQ ID NO:91) which can be used to amplify this marker.

FIG. 19 provides an alignment of the molecular marker QTL6SNP14 developed from BAC end sequences of the three Mo17 BAC sequences covering the QTL6 region. The QTL6SNP14-ASK marker (SEQ ID NO:25) is aligned with the corresponding sequence from QTL6SNP14-EF09B (SEQ ID NO:26). The alignment also provides the forward primer (SEQ ID NO:92) and the reverse primer (SEQ ID NO:93) that can be used to amplify this marker.

FIG. 20 provides an alignment of the molecular marker QTL6SNP15 developed from BAC end sequences of the three Mo17 BAC sequences covering the QTL6 region. The QTL6SNP15-ASK marker (SEQ ID NO:27) is aligned with the corresponding sequence from QTL6SNP15-EF09B (SEQ ID NO:28). The alignment also provides the forward primer (SEQ ID NO:94) and the reverse primer (SEQ ID NO:95) that can be used to amplify this marker.

FIG. 21 provides an alignment of the molecular marker QTL6SNP16 developed from BAC end sequences of the three Mo17 BAC sequences covering the QTL6 region. The QTL6SNP16-ASK marker (SEQ ID NO:29) is aligned with the corresponding sequence from QTL6SNP16-EF09B (SEQ ID NO:30). The alignment also provides the forward primer (SEQ ID NO:96) and the reverse primer (SEQ ID NO:97) that can be used to amplify this marker.

FIG. 22 provides an alignment of the molecular marker QTL6SNP17 developed from BAC end sequences of the three Mo17 BAC sequences covering the QTL6 region. The QTL6SNP17-ASK marker (SEQ ID NO:31) is aligned with the corresponding sequence from QTL6SNP17-EF09B (SEQ ID NO:32). The alignment also provides the forward primer (SEQ ID NO:98) and the reverse primer (SEQ ID NO:99) that can be used to amplify this marker.

FIG. 23 provides an alignment of the molecular marker QTL6MZA5002 developed from BAC end sequences of the three Mo17 BAC sequences covering the QTL6 region. The QTL6MZA5002-ASK marker (SEQ ID NO:33) is aligned with the corresponding sequence from QTL6MZA5002-EF09B (SEQ ID NO:34). The alignment also provides the forward primer (SEQ ID NO:100) and the reverse primer (SEQ ID NO:101) that can be used to amplify this marker.

FIG. 24 provides an alignment of the molecular marker QTL6MZA13321 developed from BAC end sequences of the three Mo17 BAC sequences covering the QTL6 region. The QTL6MZA13321-ASK marker (SEQ ID NO:35) is aligned with the corresponding sequence from QTL6MZA13321-EF09B (SEQ ID NO:36). The alignment also provides the forward primer (SEQ ID NO:102) and the reverse primer (SEQ ID NO:103) that can be used to amplify this marker.

FIG. 28 provides an alignment of the molecular marker QTL6MZA9351 developed from BAC end sequences of the three Mo17 BAC sequences covering the QTL6 region. The QTL6MZA9351-ASK marker (SEQ ID NO:43) is aligned with the corresponding sequence from QTL6MZA9351-EF09B (SEQ ID NO:44). The alignment also provides the forward primer (SEQ ID NO:110) and the reverse primer (SEQ ID NO:111) that can be used to amplify this marker.

FIG. 29 provides an alignment of the molecular marker QTL6MZA8135 developed from BAC end sequences of the three Mo17 BAC sequences covering the QTL6 region. The QTL6MZA8135-ASK marker (SEQ ID NO:45) is aligned with the corresponding sequence from QTL6MZA8135-EF09B (SEQ ID NO:46). The alignment also provides the forward primer (SEQ ID NO:112) and the reverse primer (SEQ ID NO:113) that can be used to amplify this marker.

FIG. 30 provides an alignment of the ZmDGAT1-2(ASK) protein (SEQ ID NO:48) with the ZmDGAT1-2 protein from the normal oil (as compared to #2 yellow) maize inbred lines EF09B (SEQ ID NO:52), Mo17 (SEQ ID NO:50), and B73 (SEQ ID NO:54). The glutamine deletion within the ZmDGAT1-2(ASK) protein is depicted as occurring at the position corresponding to $Gln_{67}$ of the normal oil ZmDGAT1-2 protein, although the deletion could occur at the position corresponding to $Gln_{64}$, $Gln_{65}$, $Gln_{66}$, or $Gln_{67}$ of the normal oil ZmDGAT1-2 protein. Also, the phenylalanine insertion within the ZmDGAT1-2(ASK) protein is depicted as corresponding to a phenylalanine insertion between Phe$_{469}$ and Ser$_{470}$ of the normal oil ZmDGAT1-2 protein. However this insertion could correspond to a phenylalanine insertion between Trp$_{467}$ and Phe$_{468}$ of the normal oil ZmDGAT1-2 protein, a phenylalanine insertion between Phe$_{468}$ and Phe$_{469}$ of the normal oil ZmDGAT1-2 protein, or a phenylalanine insertion between Phe$_{469}$ and Ser$_{470}$ of the normal oil ZmDGAT1-2 protein.

FIG. 31 provides an alignment of the coding sequence for the ZmDGAT1-2(ASK) protein (SEQ ID NO:47) with the coding sequence for ZmDGAT1-2 protein from the normal oil maize inbred lines EF09B (SEQ ID NO:51), Mo17 (SEQ ID NO:49), and B73 (SEQ ID NO:53). Note that in this alignment, the polymorphic change (deletion of a CAG codon within the ZmDGAT1-2(ASK) coding sequence set forth in SEQ ID NO:47) that results in a deletion of a glutamine residue within the ZmDGAT1-2(ASK) protein is depicted as occurring within the codon for the glutamine residue corresponding to position 67 of the normal oil ZmDGAT1-2 protein. However, given the stretch of four repeating glutamine residues within the normal oil ZmDGAT1-2 protein, the polymorphic change (deletion of a CAG codon) could occur within the codon for the glutamine residue corresponding to position 64 of the normal oil ZmDGAT1-2 (i.e., represented by deletion of nucleotides (nt) 190-192 of the coding sequence for normal oil ZmDGAT1-2 set forth in SEQ ID NO:51, 49, or 53), position 65 of the normal oil ZmDGAT1-2 protein (i.e., represented by deletion of nt 193-195 of SEQ ID NO:51, 49, or 53), position 66 of the normal oil ZmDGAT1-2 protein (i.e., represented by deletion of nt 196-198 of SEQ ID NO:51, 49, or 53), or position 67 of the normal oil ZmDGAT1-2 protein (i.e., represented by deletion of nt 199-201 of SEQ ID NO:51, 49, or 53 as shown here).

Also, in this alignment, the polymorphic change (insertion of a TTC codon within the ZmDGAT1-2(ASK) coding sequence set forth in SEQ ID NO:47) that results in an insertion of the phenylalanine residue within the ZmDGAT1-2 (ASK) protein is depicted as occurring between the codon for the phenylalanine residue corresponding to position 469 of the normal oil ZmDGAT1-2 protein and the codon for the serine residue corresponding to position 470 of the normal oil ZmDGAT1-2 protein. However, given the stretch of three repeating phenylalanine residues within the ZmDGAT1-2 (ASK) protein, the polymorphic change (insertion of a TTC codon) could occur between the last nucleotide of the codon for the tryptophan residue corresponding to position 467 and the first nucleotide of the codon for the phenylalanine residue corresponding to position 468 of the normal oil ZmDGAT1-2 protein (i.e., between nucleotides (nt) 1401 and 1402 of the coding sequence for normal oil ZmDGAT1-2 set forth in SEQ ID NO:51, 49, or 53), between the last nucleotide of the codon for the phenylalanine residue corresponding to position 468 and the first nucleotide of the codon for the phenylalanine residue corresponding to position 469 of the normal oil ZmDGAT1-2 protein (i.e., between nt 1404 and 1405 of SEQ ID NO:51, 49, or 53), or between the last nucleotide of the codon for the phenylalanine residue corresponding to position 469 and the first nucleotide of the codon for the serine residue corresponding to position 470 of the normal oil ZmDGAT1-2 protein (i.e., between nt 1407 and 1408 of SEQ ID NO:51, 49, or 53 as shown here).

Figure 32:
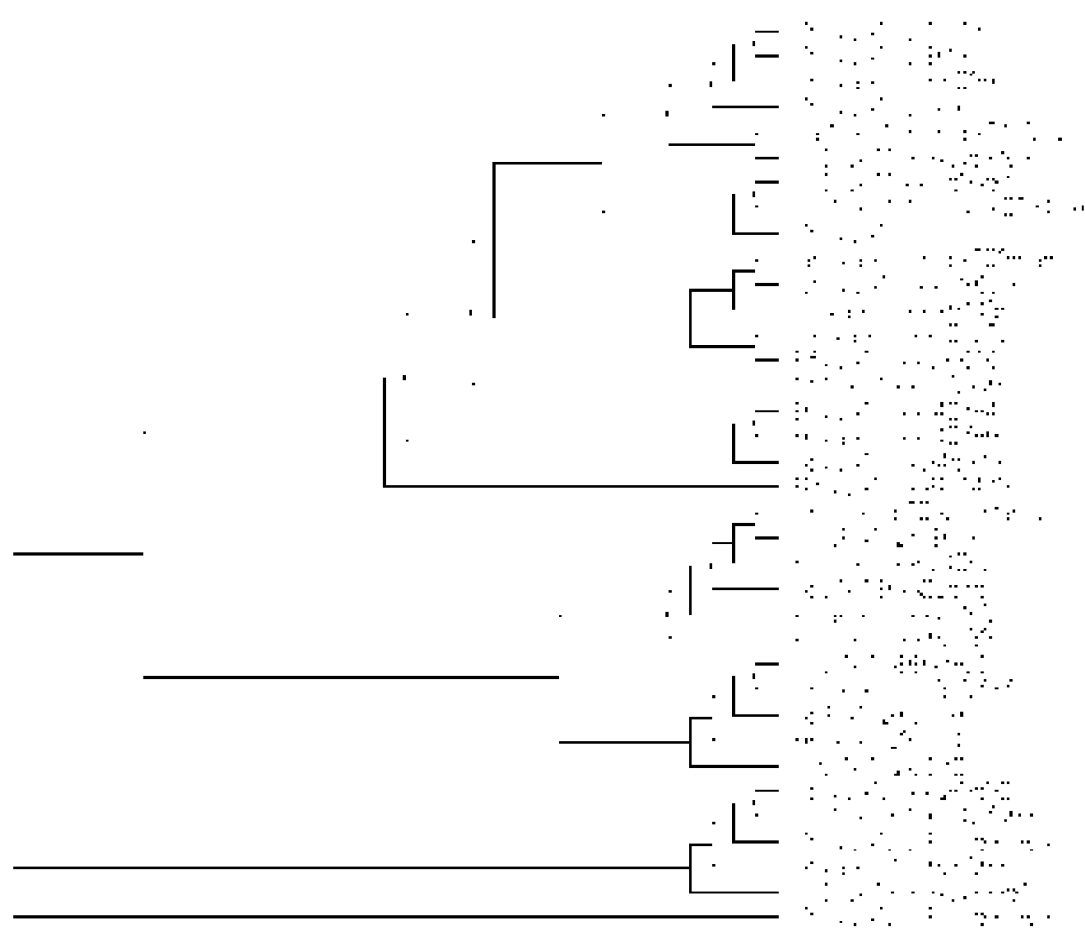

FIG. 32 shows the results of phylogenic analysis of DGATs and related sequences. Phylogenic analysis was performed using PHYLIP program (J. Felsenstein, University of Washington) and displayed using TreeView program (Page (1996) *Computer Appl. Biosci.* 12:357-358). Accession numbers are provided for public sequences. Proprietary sequences are indicated by EST clone names or by Unicorn gene names (PCOs).

Figure 33C:
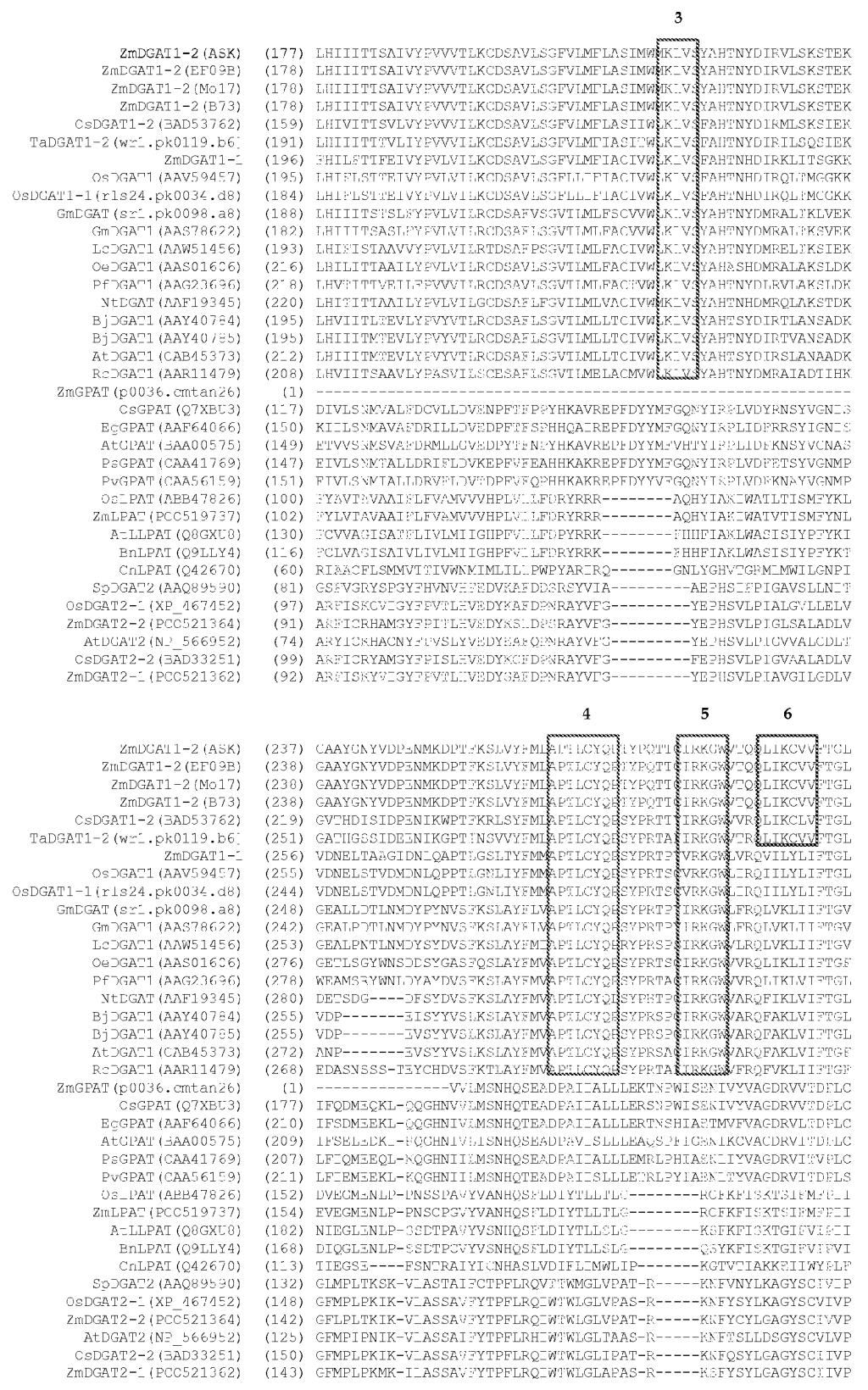
Figure 33D:
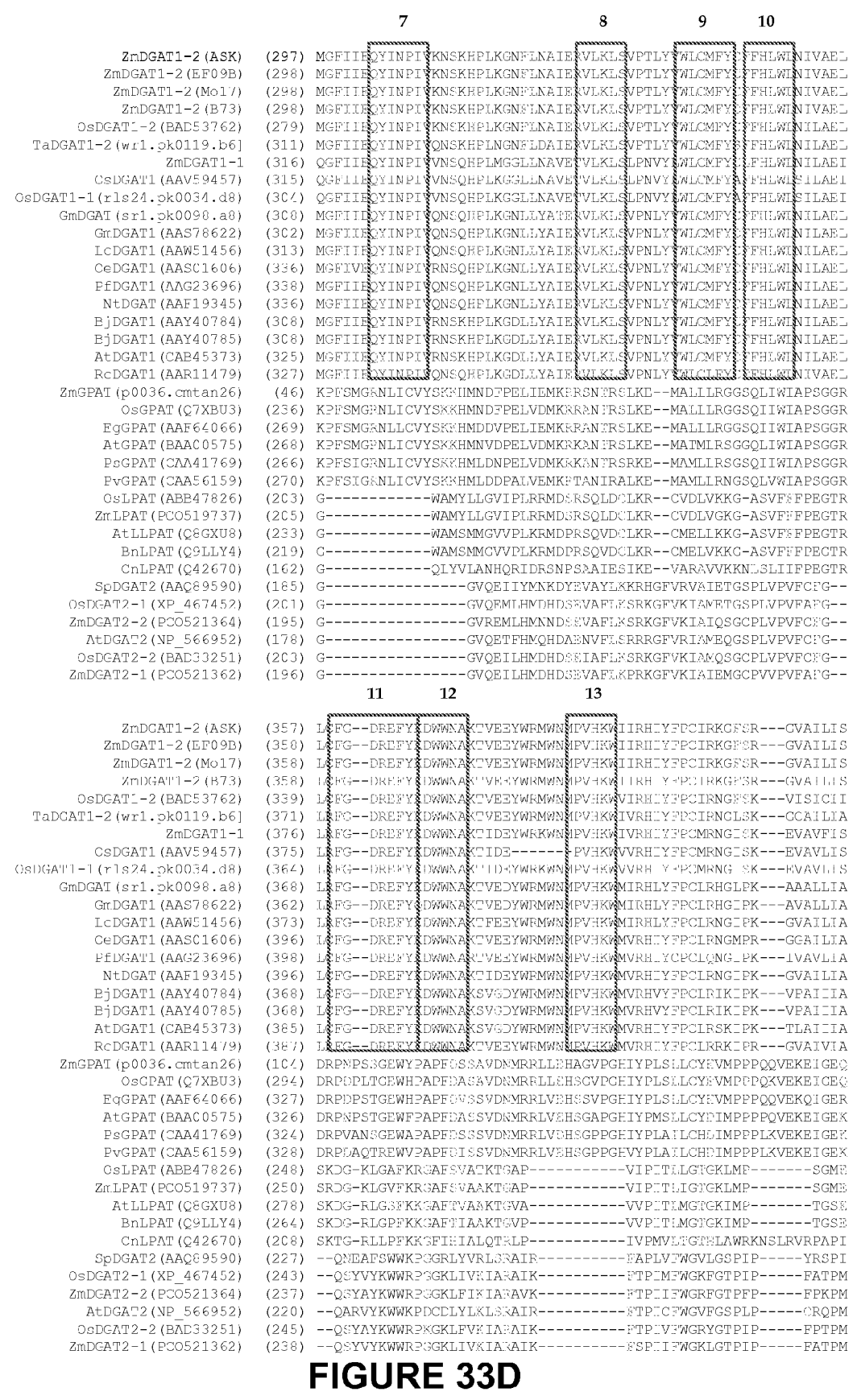

FIG. 33 shows the amino acid sequence alignment of DGATs and related acyltransferases. Vector NTI program is used for multiple alignments with CLUSTALW method (Higgins et al. (1994) *Nucleic Acids Res.* 22:4673-4680). Larger boxes (numbered 1, 2, 3, 4, 5, 7, 8, 9, 10, 11, 12, 13, 14, 15, 16, and 17) indicate sequence domains conserved in all plant DGAT1. The two smaller boxes (numbered 6 and 18) indicate sequence domains unique to all members of the subgroup DGAT1-2.

FIG. 34 provides an alignment of the ZmAAP1 protein with other known proteins.

FIG. 35 provides an alignment of the ZmPESP protein with other known proteins.

FIG. 36 provides an alignment of the ZmS24 protein with other known proteins.

FIG. 37 provides an alignment of the ZmABCT protein with other known proteins.

Figure 38C:

FIG. 38 provides a sequence alignment of various members of the HAP3 transcriptional activator family. The alignment provides a consensus sequence and also outlines the domains A, B, and C.

Figure 39:
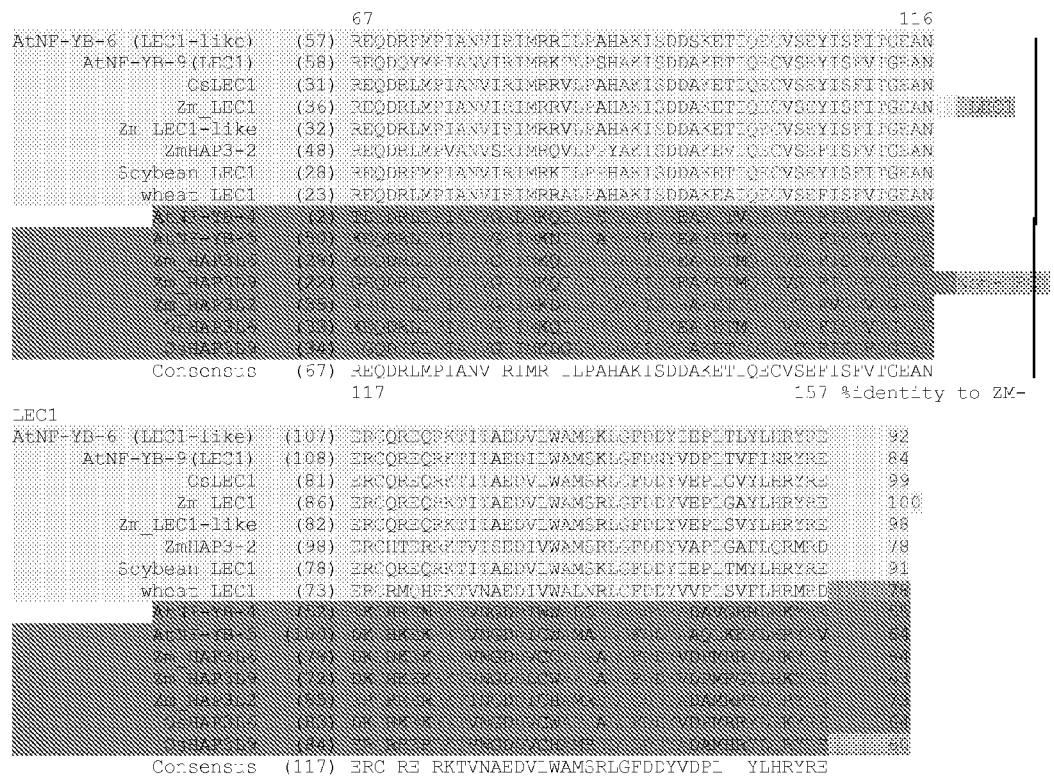

FIG. 39 provides a sequence alignment of various LEC-1 type B domains (light shading) and non-LEC1 type B domains (dark shading).

Figure 40:
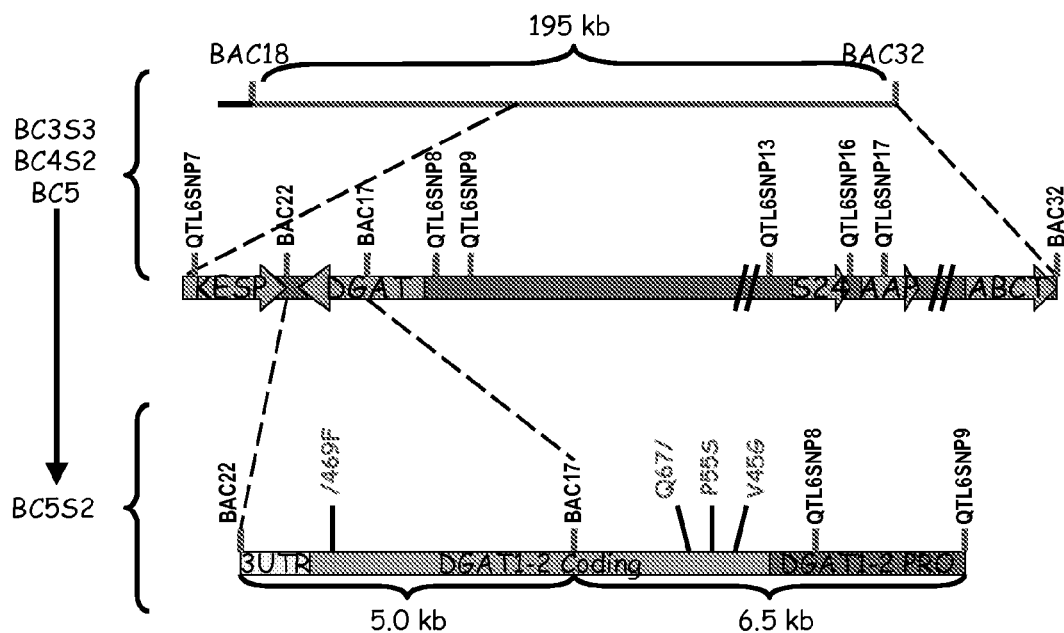

FIG. 40 illustrates the final mapping of QTL6. The high oil/high oleic acid QTL6 was previously mapped to a region of approximately 195 kb, containing five genes. To map QTL6 further, eight new SNP markers (QTL6SNP7, 8, 9, 13, 14, 15, 16, and 17) within this region were developed based on Mo17 BAC sequences (not all markers are shown). Approximately 4,000 BC5S1 seeds segregating for QTL6 were planted in small pots and grown in the greenhouse. Seedlings were genotyped by markers BAC17 and BAC32 for identification of recombinants between DGAT1-2 and the PDR-like ABC transporter genes. A total of 90 recombinant plants were identified and were further genotyped by the new SNP markers to identify the precise location of crossovers. Recombinant plants were transferred to regular pots and self-pollinated to produce BC5S2 seeds. Oil and oleic acid data were obtained from 14 critical recombinant ears as described in the examples herein below.

FIG. 41 shows embryo oil concentration (A), seed oil concentration (B), oleic acid concentration (C), and linoleic acid concentration (D) for maize plants transgenic for the ASKC28Ib1 or EF09B allele of DGAT1-2. Segregating T1 seeds were sorted as transgenic or null kernels using red fluorescence as a marker. Methods for oil analysis and fatty acid profiling were as described in the examples herein below. Change % refers to the difference between fluorescence-positive seeds and fluorescence-negative seeds in transgenic lines or ASKC2IB1 homozygous vs. EF09B homozygous seeds in the BC4S2 NILs. Transgenic data represent averages of 10 events, 10 transgenic and 10 null seeds analyzed per event. BC4S2 data represent averages of 5 homozygous ASKC28IB1 and 5 homozygous EF09B NILs, 10 seeds per line analyzed.

Figure 42A:
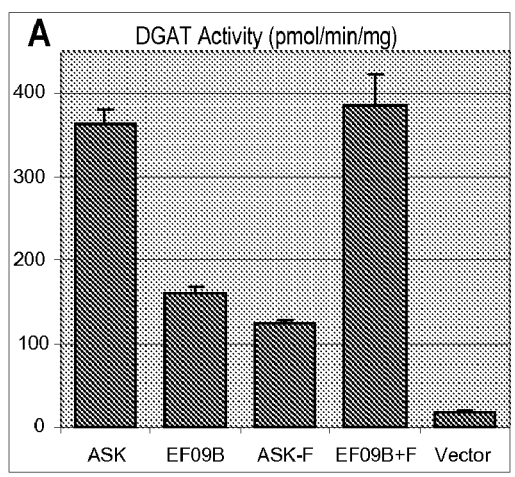

FIG. 42 shows the results of a DGAT activity assay (A) and TAG accumulation in yeast cells (B). ASK, the original allele of DGAT1-2 cDNA isolated from ASKC28IB1 parent (ZmDGAT1-2(ASK)) of SEQ ID NO:47). EF09B, the original allele of DGAT1-2 cDNA isolated from EF09B parent (ZmDGAT1-2(EF09B) of SEQ ID NO:51). ASK-F, ASKC28IB1 allele (SEQ ID NO:47) with the codon for the F469 residue of the encoded polypeptide (ZmDGAT1-2(ASK) of SEQ ID NO:48) deleted. EF09B+F, EF09B allele (SEQ ID NO:51) with an insertion of a TTC codon between the codon for F469 and the codon for S470 of SEQ ID NO:52 to restore the phenylalanine residue corresponding to the F469 insertion in ZmDGAT1-2(ASK) of SEQ ID NO:48. Methods for DGAT assay and TAG amount measurement are as described in the example herein below. DGAT activity data are the averages of four repeats. TAG data are the averages of three repeats.

FIG. 43 shows the DGAT1-2 allele distribution in selected corn inbreds. Embryo oil and oleic acid contents for 73 selected inbreds were determined as described. DNA was extracted from leaf disks using seedlings approximately 3-weeks old. DGAT1-2 primers (SEQ ID NOs:124/125 and 126/127) were used to PCR-amplify fragments encompassing the three amino acid changes at the N-terminus region of DGAT1-2(ASK) (i.e., V45G; P55S; and the Q64, Q65, Q66, or Q67 deletion) or the phenylalanine insertion at position 467, 468, or 469 at the C-terminus of DGAT1-2(ASK). PCR fragments were sequenced to determine the alleles.

Figure 44:
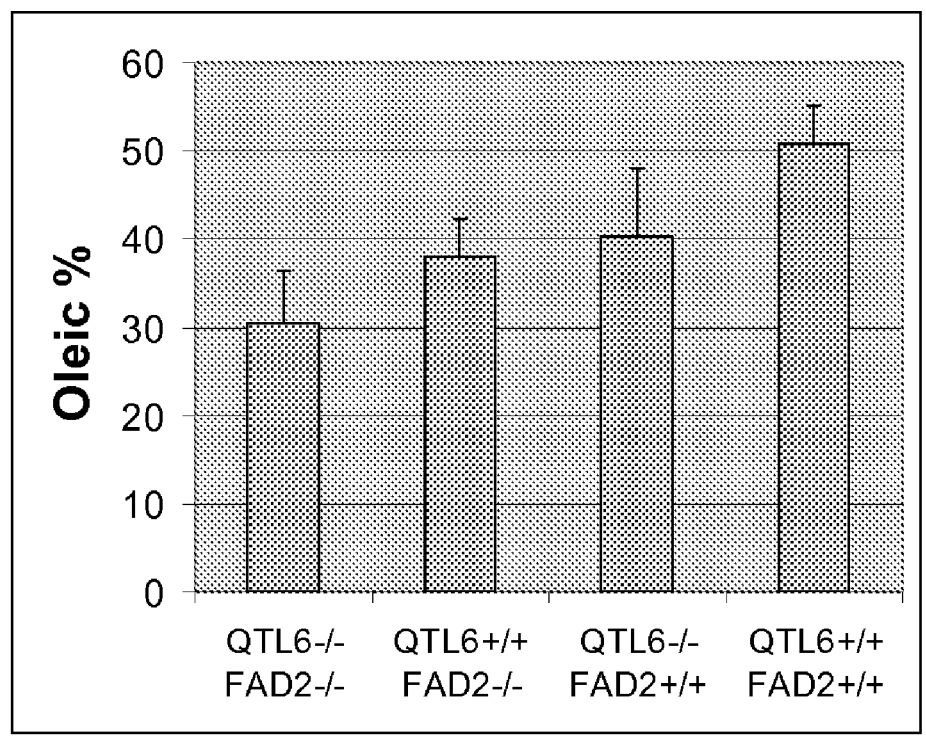

FIG. 44 demonstrates that QTL6 (DGAT1-2) and FAD2 are additive in increasing oleic acid content. QTL6+/+, homozygous ASKC28IB1 allele; QTL6−/−, homozygous EF09B allele; FAD2+/+, homozygous favorable allele; FAD2−/−, homozygous unfavorable allele. Oleic acid concentration was determined using hexane extraction and GC as described in the examples herein below. The remaining seed residue from hexane extraction was used for DNA isolation with Qiagen's DNeasy Plant Mini Kit (Cat. No. 69104). DGAT1-2 and FAD2 alleles were determined by gene specific PCR amplification and CAP marker analysis.

DETAILED DESCRIPTION OF THE INVENTION

The present invention now will be described more fully hereinafter with reference to the accompanying examples, in which some, but not all embodiments of the invention are shown. Indeed, this invention may be embodied in many different forms and should not be construed as limited to the embodiments set forth herein; rather, these embodiments are provided so that this disclosure will satisfy applicable legal requirements. Like numbers refer to like elements throughout.

Many modifications and other embodiments of the invention set forth herein will come to mind to one skilled in the art to which this invention pertain having the benefit of the teachings presented in the foregoing descriptions. Therefore, it is to be understood that the invention is not to be limited to the specific embodiments disclosed and that modifications and other embodiments are intended to be included within the scope of the appended claims. Although specific terms are employed herein, they are used in a generic and descriptive sense only and not for purposes of limitation.

The articles "a" and "an" are used herein to refer to one or more than one (i.e., to at least one) of the grammatical object of the article. By way of example, "an element" means one or more than one element.

I. Overview

A "quantitative trait locus" or "QTL" refers to a genetically defined location for a collection of one or more genes (alleles) that contribute to an observed characteristic. The present invention has developed near isogenic lines for QTL6, which is a prominent oil QTL, and has demonstrated that QTL6 is a major QTL controlling embryo oil concentrations and oleic acid concentrations, and thus the oleic acid/linoleic acid ratio. Various methods and compositions for the breeding and manipulation of QTL6 are provided. Compositions comprise novel marker loci that segregate with QTL6, and methods of employing these markers in marker-assisted maize breeding programs to identify maize plants or germplasm that have an increased oil content, an increased oleic acid content, or an increased oleic acid/linoleic acid ratio are provided. The present invention further maps QTL6 to an approximately 195-kb region that comprises multiple open reading frames, which are characterized in further detail below. The polynucleotides and polypeptides associated with QTL6 can be used in various methods to increase oil content and/or oleic acid content in a plant of interest, and/or to increase the oleic acid content relative to the linoleic acid content, and thus yield a higher oleic acid/linoleic acid ratio. Of particular interest to the present invention are novel marker loci that are associated with a high-oil and/or high-oleic acid and/or high oleic acid/low linoleic acid phenotype, and which genetically segregate with a QTL6 region that is flanked by a first border sequence that comprises nucleotides 1-20 of SEQ ID NO:2 herein (referred to as the "BAC05 border") and a second border sequence that comprises nucleotides 477-496 of SEQ ID NO:46 herein (referred to as the "MZA8135 border"). Also of interest to the present invention are novel marker loci mapped within a further defined region within this QTL6 region, wherein the further defined region comprises a first border sequence that comprises nucleotides 1-20 of SEQ ID NO:6 (referred to as the "BAC18 QTL6 left border"; see FIG. 6) and a second border sequence that comprises nucleotides 482-501 of SEQ ID NO:14 (referred to as the "BAC29 QTL6 right border"; see FIG. 6). Of further interest to the present invention is a novel marker locus mapped within a second further defined region within this QTL6 region, wherein the second further defined region comprises a first border sequence that comprises nucleotides 1-20 of SEQ ID NO:10 (referred to as the "BAC22 QTL6 left border"; see FIG. 11) and a second border sequence that comprises nucleotides 488-507 of SEQ ID NO:4 (referred to as the BAC17 QTL6 right border).

Accordingly, the present invention provides both novel breeding techniques, plants and plant parts, along with novel polynucleotides and polypeptides each of which can be employed to increase oil content, increase oleic acid content, and/or increase the oleic acid/linoleic acid ratio within a plant or plant part. As used herein, "increasing oil content" includes any increase in the level of oil in the plant or plant part, for example, in the seed or kernel and/or the embryo or germ, or any combination thereof. In specific embodiments, the increase in oil occurs in the germ and/or in the kernel. For example, increased oil content can comprise an increase in overall oil level in the plant or plant part of about 0.1%, 0.5%, 1%, 5%, 10%, 20%, 30%, 40%, 50%, 60%, 70%, 80%, 90%, 100%, 120%, or greater when compared to a control plant or plant part. Alternatively, the increased level of oil can include about a 0.5-fold, 1-fold, 2-fold, 4-fold, 8-fold, 16-fold, 32-fold, or greater overall increase in oil level in the plant or the plant part when compared to a control plant or plant part.

The levels of the various constituents in the oil can also be modulated using the various methods and compositions of the invention. For example, "increasing oleic acid content" includes any increase in the level of oleic acid or any alteration in the ratio of oleic acid to other oil constituents in a plant or plant part, for example, the seed or kernel and/or the embryo or germ, or any combination thereof. For example, increasing oleic acid content can comprise an increase in the overall oleic acid level of about 0.1%, 0.5%, 1%, 5%, 10%, 20%, 30%, 40%, 50%, 60%, 70%, 80%, 90%, 100%, 120%, or greater when compared to a control plant or plant part. Alternatively, the increased oleic acid level can include about a 0.5-fold, 1-fold, 2-fold, 4-fold, 8-fold, 16-fold, 32-fold, or greater increase in oleic acid level in the plant or the plant part when compared to a control plant or plant part.

The delta-12 single bond of oleic acid (C18:1) can be converted into a conjugated double bond, thus producing linoleic acid (C18:2). Therefore, increasing oleic acid content can further modulate the ratio of oleic acid to linoleic acid in a plant or plant part. In this manner, the methods and compositions of the present invention can be used to increase the oleic acid/linoleic acid ratio in a plant or plant part. For example, "increasing oleic acid/linoleic acid ratio" includes any incremental increase in the ratio of oleic acid to linoleic acid within a plant or plant part, for example, the seed or kernel and/or the embryo or germ, or any combination thereof. Thus, for example, the oleic acid/linoleic acid ratio within a plant or plant part can be increased by about 0.1%, 0.5%, 1%, 5%, 10%, 20%, 30%, 40%, 50%, 60%, 70%, 80%, 90%, 100%, 120%, or greater when compared to a control plant or plant part. Alternatively, the increased oleic acid/linoleic acid ratio can include about a 0.5-fold, 1-fold, 2-fold, 4-fold, 8-fold, 16-fold, 32-fold, or greater increase in the oleic acid/linoleic acid ratio in the plant or the plant part when compared to a control plant or plant part. Methods to assay for oleic acid and linoleic acid levels are known in the art. See, for example, U.S. Patent Application Publication No. 20050160494, herein incorporated by reference in its entirety. Using the methods and compositions disclosed herein, total oil production can be increased and/or the characteristics of the oil can be modified.

Oil and/or oil constituents, such as oleic acid and linoleic acid, can be measured by any method known in the art. In order to make a determination of the amount of oil in seeds and/or the amount of specific fatty acids present in the oil and their respective concentrations, mature seeds can be crushed (e.g., in a hydraulic press), and the endogenous oil can be readily extracted with hexane or by other suitable techniques in accordance with procedures known in the art. Similarly, any plant tissue can be ground or crushed and then extracted with hexane to recover oil. The hexane can be separated from the oil by evaporation, and the amount of oil remaining determined. The fatty acids can be determined following transmethylation. The resulting methyl esters of the fatty acids can be separated, and their concentrations determined by use of capillary gas chromatography in accordance with standard operating procedures known in the art. In addition, the quantitation of oil content of seeds can be performed with conventional methods, such as near infrared analysis (NIR), nuclear magnetic resonance imaging (NMR), soxhlet extraction, accelerated solvent extraction (ASE), microwave extraction, and super critical fluid extraction. Near infrared (NIR) spectroscopy has become a standard method for screening seed samples whenever the sample of interest has been amenable to this technique. Samples studied include wheat, maize, soybean, canola, rice, alfalfa, oat, and others. Methods of measuring oil and oil constituents in maize kernels, dissected germ, and endosperm are disclosed, for example, in WO 2005/003312 and WO 02/062129, herein incorporated by reference in their entirety.

II. Characterization of QTL6

(A) Marker Loci for QTL6

Compositions comprising markers for the QTL6 locus are provided. As used herein, a "genetic marker" is any morphological, biochemical, or nucleic acid-based phenotypic difference that reveals a DNA polymorphism. Examples of genetic markers include, but are not limited to, RFLPs (restriction fragment length polymorphisms), RAPDs (random-amplified polymorphic DNA), single-nucleotide polymorphisms (SNPS), allozymes, SSRs (simple sequence repeats), and AFLPs (amplification fragment length polymorphisms). The term "marker locus" refers to a genetically defined location of a DNA polymorphism. Such marker loci can be used as a point of reference when identifying genetically linked loci.

A "genetic map" is a description of the genetic linkage relationships among loci on one or more chromosomes (or linkage groups) within a given species, generally depicted in a diagrammatic or tabular form. "Mapping" is the process of defining the linkage relationships of loci through the use of genetic markers, populations segregating for the markers, and standard genetic principles of recombination frequency. A "map location" is an assigned location on a genetic map relative to linked genetic markers where a specified marker can be found within a given species.

The methods and compositions of the invention require detection of at least one polymorphism or any combination of the polymorphisms within a favorable marker locus disclosed herein. The term "favorable marker locus" refers to a marker locus that genetically segregates with the QTL6 region disclosed herein and which is associated with the desirable plant phenotypic trait of high oil content and/or high oleic acid content and/or increased oleic acid/linoleic acid ratio within the plant or one or more plant parts thereof. Non-limiting examples of sequences corresponding to these favorable marker loci are provided in SEQ ID NOs:2, 4, 6, 8, 10, 12, 14, 16, 18, 20, 22, 24, 26, 28, 30, 32, 34, 36, 38, 40, 42, 44, 46, and 51 with at least one polymorphism contained therein. Examples of specific polymorphisms within each favorable marker locus of the QTL6 region are identified in Table 2 (non-coding marker loci) and Table 3 (marker locus comprising coding sequence) in Examples 2 and 4 herein below. Non-limiting examples of sequences for favorable marker loci of the invention are set forth in SEQ ID NOs:1, 3, 5, 7, 9, 11, 13, 15, 17, 19, 21, 23, 25, 27, 29, 31, 33, 35, 37, 39, 41, 43, 45, and 47, and the respective polymorphism(s) occurring within these favorable marker loci are shown in Tables 2 and 3 herein below. See also the alignments shown in FIGS. 7-29 and 31.

As used herein, an "allele of a marker locus" is one of a plurality of polymorphic nucleotide sequences at a marker locus. For purposes of the present invention, an "allele of a favorable marker locus of the invention" comprises at least one of the polymorphic changes found at the favorable marker locus. Accordingly, an allele of the favorable marker locus can have at least 1, 2, 3, 4, 5, 6, 7, 8, 9, 10 or greater of the polymorphic nucleotides found at the favorable marker locus disclosed herein. Thus, an allele of a marker locus can have at least 90%, 91%, 92%, 93%, 94%, 95%, 96%, 97%, 98%, or 99% sequence identity to the favorable marker locus disclosed herein.

In the context of the present invention, a marker locus can be associated with another marker locus, with some other genetic locus (for example, a high oil locus and/or a high oleic acid locus, such as QTL6), and/or with a trait (i.e., high oil content, high oleic acid content, and/or high oleic acid/linoleic acid ratio). By "associated with" is intended that the marker locus and the second marker locus or the marker locus and the genetic locus are in the same linkage group and are in linkage disequilibrium with one another. "Linkage disequilibrium" is defined as the non-random segregation of alleles at two or more loci. Linkage disequilibrium therefore describes a situation in which the combinations of alleles or genetic markers occur more frequently in a population than would be expected from a random formation of haplotypes from alleles based on their frequencies. The term "genetically linked" refers to genetic loci that are in linkage disequilibrium and have been stastically determined to not sort independently. Genetically linked loci cosegregate more than 50% of the time.

As used herein, a marker that is genetically linked to another marker of the genetic locus will be in the same linkage group and typically within 10 centimorgans (cM) of each other. For example, a marker locus of the present invention is associated with the high oil content and/or high oleic acid content and/or increased oleic acid/linoleic acid ratio trait if the marker and the sequence conferring the phenotypic trait of high oil content and/or high oleic acid content and/or increased oleic acid/linoleic acid ratio are not more than 10 cM, 9 cM, 8 cM, 7 cM, 6 cM, 5 cM, 4 cM, 3 cM, 2 cM, 1 cM, 0.75 cM, 0.5 cM, 0.25 cM or less apart on the same linkage group. That is, the two associated genetic elements undergo recombination during meiosis with each other at a frequency of less than or equal to about 10%, 9%, 8%, 7%, 6%, 5%, 4%, 3%, 2%, 1%, 0.75%, 0.5%, 0.25% or less. Each of the identified markers are expected to be in close physical or genetic proximity (resulting in the physical and/or genetic linkage) to a genetic element (QTL6) that contributes to an increased oil content and/or increased oleic acid content and/or increased oleic acid/linoleic acid ratio.

As used herein, the term "closely linked" means that the recombination between two linked loci occurs with a frequency of about 10%, 9%, 8%, 7%, 6%, 5%, 4%, 3%, 2%, 1%, 0.75%, 0.5%, 0.25% or less. In other words, the closely linked loci co-segregate at least about 90% of the time. Thus, the closely linked marker loci of the invention, are sufficiently proximal to the trait that confers increased oil content and/or increased oleic acid content and/or increased oleic acid/linoleic acid ratio that they can be used as a predictor for the trait itself.

In one embodiment, the favorable marker locus genetically linked to QTL6 comprises the polynucleotide set forth in any one of SEQ ID NOs:1, 3, 5, 7, 9, 11, 13, 15, 17, 19, 21, 23, 25, 27, 29, 31, 33, 35, 37, 39, 41, 43, and 45. The favorable marker loci set forth in SEQ ID NOs:1, 3, 5, 7, 9, 11, 13, 15, 17, 19, 21, 23, 25, 27, 29, 31, 33, 35, 37, 39, 41, 43, and 45, which are associated with the high oil content and/or high oleic acid content and/or increased oleic acid/linoleic acid ratio phenotypic trait, are aligned in FIGS. 7-29 with the sequence for the corresponding marker locus for the EF09B (normal oil) maize inbred line. The present invention further provides alleles of marker loci genetically linked to QTL6.

In other embodiments, the favorable marker locus is an expressed nucleic acid that is associated with the desirable high oil content and/or high oleic acid content and/or increased oleic acid/linoleic acid ratio phenotypic trait. In still other embodiments, the favorable marker locus is within the polynucleotide encoding DGAT, for example, within the polynucleotide encoding DGAT1-2. For example, the favorable marker locus can comprise a polymorphism in the polynucleotide encoding ZmDGAT1-2 (for example, the coding sequence set forth in SEQ ID NO:51) wherein the polymorphic change to the ZmDGAT1-2 coding sequence results in a glycine residue substitution for the serine residue at the amino acid position corresponding to residue 45 of SEQ ID NO:52; a serine residue substitution for the proline residue at the amino acid position corresponding to residue 55 of SEQ ID NO:52; a deletion of the glutamine residue corresponding to that at amino acid position 64, 65, 66, or 67 of SEQ ID NO:52; and/or an insertion of a phenylalanine residue at a position located between a pair of residues, wherein the pair of residues corresponds to a pair of residues within SEQ ID NO:52 selected from the group consisting of: (a) the tryptophan residue at amino acid position 467 of SEQ ID NO:52 and the phenylalanine residue at amino acid position 468 of SEQ ID NO:52, (b) the phenylalanine residue at amino acid position 468 of SEQ ID NO: 52 and the phenylalanine residue at amino acid position 469 of SEQ ID NO:52, and (c) the phenylalanine residue at amino acid position 469 of SEQ ID NO:52 and the serine residue at amino acid position 470 of SEQ ID NO:52. A non-limiting example of a favorable marker locus within a polynucleotide encoding DGAT1-2 is a sequence comprising the sequence set forth in SEQ ID NO:47, which encodes the ZmDGAT1-2(ASK) protein set forth in SEQ ID NO:48. The specific polymorphic changes to the coding sequence for the ZmDGAT1-2(ASK) protein of SEQ ID NO:48 are exemplified in FIG. 31 (see also the description for this figure provided herein above), and described in Table 3 herein below. See also the alignment of the ZmDGAT1-2(ASK) protein with the ZmDGAT1-2 protein from three normal oil maize inbred lines (FIG. 30) and the description for this figure provided herein above.

One of skill in the art will appreciate that the marker loci provided and discussed herein are merely exemplary and that numerous other linked marker loci can be identified based on genetic linkage and/or physical proximity on a chromosome to the marker loci provided herein. Thus, the compositions and methods of the present invention described herein are not intended to be limited to the favorable marker loci comprising SEQ ID NOs:2, 4, 6, 8, 10, 12, 14, 16, 18, 20, 22, 24, 26, 28, 30, 32, 34, 36, 38, 40, 42, 44, 46, and 51 with at least one polymorphism contained therein, or to the examples of sequences for these favorable marker loci as set forth in SEQ ID NOs:1, 3, 5, 7, 9, 11, 13, 15, 17, 19, 21, 23, 25, 27, 29, 31, 33, 35, 37, 39, 41, 43, 45, and 47 but also include additional markers linked thereto. Additionally, while favorable alleles of the exemplary marker loci are disclosed herein, it will be readily appreciated by those of skill in the art, that favorable alleles of additional loci linked to the marker loci described herein can be determined without undue experimentation and employed in the compositions and methods of the present invention. Accordingly, any marker locus linked to the marker loci described herein, and localized to a chromosome segment identified by the marker loci of the invention, can also be used to identify that chromosome segment, and to define the genotype of a plant of interest, or to select for favorable allelic forms of a chromosome segment correlated with the high oil content and/or high oleic acid content and/or increased oleic acid/linoleic acid ratio phenotypic trait.

At least one of the polymorphisms present in one or more of the favorable marker loci disclosed herein can be used to identify a first maize plant or a first maize germplasm that has an increased oil content or an increased oleic acid content or an increased oleic acid/linoleic acid ratio, and thus comprises the high oil content and/or high oleic acid content and/or increased oleic acid/linoleic acid ratio phenotypic trait. In this manner, the present invention provides such an identification method, comprising detecting in the first maize plant or the first maize germplasm at least one polymorphism within one or more of the favorable marker loci that are associated with the increased oil content, the increased oleic acid content, and/or the increased oleic acid/linoleic acid ratio trait. In specific embodiments, marker polymorphisms from more than one marker locus can be employed. Thus, aspects of the invention use a collection of different marker loci. The number of marker loci in such a collection will vary and be, for example, 2, 3, 4, 5, 6, 7, 8, 9, 10, 15, 20, 25, or greater.

Various methods are known in the art for detecting the favorable marker loci of the present invention. Detecting at least one polymorphism of the favorable marker loci can include, but is not limited to, detecting one or more of the polymorphisms by restriction fragment length polymorphism (RFLP), single base extension, electrophoresis, sequence alignment, allelic specific oligonucleotide hybridization (ASO), RAPD, detection of amplified variable sequences of the plant genome, detection of simple sequence repeats (SSRs), and detection of single nucleotide polymorphism (SNPs), etc. Marker assays include single base extension as disclosed in U.S. Pat. No. 6,013,431 and allelic discrimination where endonuclease activity releases a reporter dye from a hybridization probe as disclosed in U.S. Pat. No. 5,538,848, the disclosures of both of which are incorporated herein by reference.

Amplification primers for amplifying favorable marker loci and suitable marker probes to detect favorable marker loci are provided. FIGS. 7-29 and SEQ ID NOs:68-115 provide specific primers that can be used to amplify the respective marker loci of the invention. One of skill in the art will recognize that other sequences to either side of the given primers can be used in place of the given primers, so long as the primers can amplify the desired allele of a favorable marker locus of the invention. In addition, marker probes to these favorable loci are also provided. Thus the present invention is not limited to the primers and probes specifically recited herein.

In one embodiment, the present invention provides an isolated polynucleotide comprising at least 12 consecutive nucleotides, wherein said sequence of said 12 consecutive nucleotides comprises at least 90%, 91%, 92%, 93%, 94%, 95%, 96%, 97%, 98%, 99%, or 100% sequence identity to the complement of an allele of a favorable marker locus comprising a sequence set forth in SEQ ID NO:1, 3, 5, 7, 9, 11, 13, 15, 17, 19, 21, 23, 25, 27, 29, 31, 33, 35, 37, 39, 41, 43, 45, or 47 wherein said polynucleotide can detect a polymorphism in a favorable marker locus associated with high oil content, high oleic acid content, and/or high oleic acid/linoleic acid ratio. In some embodiments, the isolated polynucleotide comprises at least 12 consecutive nucleotides of the sequence set for thin SEQ ID NO:1, 3, 5, 7, 9, 11, 13, 15, 17, 19, 21, 23, 25, 27, 29, 31, 33, 35, 37, 39, 41, 43, 45, or 47. In other embodiments, the isolated polynucleotide comprises a detectable label. The detectable label can be, for example, a radioactive element or a dye. In some embodiments, the primer or probe of the invention further comprises a fluorescent label and a quencher, e.g., for use in hybridization probe assays of the type known as Taqman assays, available from Applied Biosystems (Foster City, Calif.).

(B) Plant Breeding

The favorable marker loci of the invention can be used in marker-assisted selection of plants having the desired high-oil phenotype, and/or high-oleic acid phenotype, and/or high oleic acid/low linoleic acid phenotype (i.e., increased oleic acid/linoleic acid ratio), and subsequent breeding of these selected plants to obtain plant genetic lines and/plant varieties having the desired high-oil phenotype, and/or high-oleic acid phenotype, and/or high oleic acid/low linoleic acid phenotype.

The term "germplasm" refers to an individual, a group of individuals, or a clone representing a genotype, variety, species or culture, or the genetic material thereof.

A "genotype" is the genetic constitution of an individual (or group of individuals) at one or more genetic loci. Genotype is defined by the allele(s) of one or more known loci that the individual has inherited from its parents. A "haplotype" is the genotype of an individual at a plurality of genetic loci. Typically, the genetic loci described by a haplotype are physically and genetically linked, i.e., on the same chromosome segment.

An individual is "homozygous" if the individual has only one type of allele at a given locus (e.g., a diploid individual with two copies of the same allele at a locus). An individual is "heterozygous" if more than one allele type is present at a given locus (e.g., a diploid individual with one copy each of two different alleles). The term "homogeneity" indicates that members of a group have the same genotype at one or more specific loci. In contrast, the term "heterogeneity" is used to indicate that individuals within the group differ in genotype at one or more specific loci.

A "line" or "strain" is a group of individuals of identical parentage that are generally inbred to some degree and that are generally isogenic or near isogenic.

The term "near-isogenic" lines refers to lines that are genetically similar to each other except at one or a small number of genetic loci (e.g., at 1, 2, or about 5 to about 10 specified genetic loci). These can be created as described for marker-based sublines or based on differences for any qualitative trait that can serve as an effective genetic marker. Percent similarity between near-isogenic lines is a function of the similarity of the parents of the original cross and the generation at which self-pollination is performed. On average, the relatedness between members of a given inbred line increases 50% with each cycle of inbreeding, due to a 50% increase in homozygosity at each cycle of inbreeding. Percent similarity can be more accurately determined with genetic markers that span the genome. In some cases, near-isogenic lines differ from each other at one defined genetic locus.

An "elite line" or "elite strain" is an agronomically superior line that has resulted from many cycles of breeding and selection for superior agronomic performance. Similarly, an "elite germplasm" is an agronomically superior germplasm, typically derived from and/or capable of giving rise to a plant with superior agronomic performance, such as an existing or newly developed elite line of maize.

Inbred maize lines are typically developed for use in the production of maize hybrids and for use as germplasm in breeding populations for the creation of new and distinct inbred maize lines. Inbred maize lines are often used as targets for the introgression of novel traits through traditional breeding and/or molecular introgression techniques. Inbred maize lines need to be highly homogeneous, homozygous, and reproducible to be useful as parents of commercial hybrids. Many analytical methods are available to determine the homozygosity and phenotypic stability of inbred lines.

The phrase "hybrid plants" refers to plants which result from a cross between genetically different individuals.

The term "crossed" or "cross" in the context of this invention means the fusion of gametes, e.g., via pollination to produce progeny (i.e., cells, seeds, or plants) in the case of plants. The term encompasses both sexual crosses (the pollination of one plant by another) and, in the case of plants, selfing (self-pollination, i.e., when the pollen and, ovule are from the same plant).

The term "introgression" refers to the transmission of a desired allele of a genetic locus from one genetic background to another. In one method, the desired alleles can be introgressed through a sexual cross between two parents, wherein at least one of one of the parents has the desired allele in its genome. The desired allele can be a marker locus, a QTL, a transgene, or the like. In some embodiments of the invention, the desired allele is an allele of a favorable marker locus disclosed herein.

i. Marker-Assisted Selection

"Marker-Assisted Selection" or "MAS" refers to the practice of selecting for desired phenotypes among members of a breeding population using genetic markers. The ultimate goal of any breeding program is to combine as many favorable alleles as possible into elite varieties of germplasm that are genetically superior (with respect to one or more agronomic traits) to their ancestors. The markers provided herein identify chromosome segments, i.e., genomic regions, and alleles (allelic forms) of the QLT6 region that are associated with the high-oil and/or high-oleic acid and/or high oleic acid/low linoleic acid phenotypic trait. Accordingly, these markers can be used for marker-assisted selection of plants, for example, maize plants, with the desired high-oil and/or high-oleic acid and/or high oleic acid/low linoleic acid (i.e., increased oleic acid/linoleic acid ratio) phenotypic trait. For example, in a cross between parents that complement favorable alleles at the target loci, progeny can be selected that include more favorable alleles than either parent.

Marker-assisted selection (MAS), employing the markers of the present invention, and the chromosome segments they identify, are useful in the context of a maize breeding program to increase oil content and/or oleic acid content and/or oleic acid/linoleic acid ratio of a plant or plant part thereof. Phenotypic screening for a trait of interest, such as high oil content, high oleic acid content, or increased oleic acid/linoleic acid ratio for large numbers of samples can be expensive, as well as time consuming. In addition, phenotypic screening alone is often unreliable due to the effects of epistasis and non-genetic (e.g., environmental) contributions to the phenotype. MAS offers the advantage over field evaluation that it can be performed at any time of year regardless of the growing season or developmental stage. In addition, MAS facilitates evaluation of organisms grown in disparate regions or under different conditions.

A breeder of ordinary skill, desiring to breed plants with increased oil content and/or increased oleic acid content and/or increased oleic acid/linoleic acid ratio, can apply the methods for MAS described herein, using, e.g., the exemplary favorable marker loci provided herein or linked marker loci localized to the chromosome segments identified by the favorable marker loci provided herein, to derive plant lines with increased oil content and/or increased oleic acid content and/or increased oleic acid/linoleic acid ratio.

Genetic marker alleles, e.g., the exemplary marker loci set forth in SEQ ID NOs: 1, 3, 5, 7, 9, 11, 13, 15, 17, 19, 21, 23, 25, 27, 29, 31, 33, 35, 37, 39, 41, 43, 45, and 47 and alleles thereof comprising one or more of the respective polymorphisms identified in Tables 2 and 3 herein below, linked markers, and QTL, identifying the chromosome segments encompassing genetic elements that are important for high oil content and/or high oleic acid content and/or increased oleic acid/linoleic acid ratio, are used to identify plants that contain a desired genotype at one or more loci, and that are expected to transfer the desired genotype, along with a desired phenotype to their progeny. Marker alleles (or QTL alleles) can be used to identify plants that contain a desired genotype at one locus, or at several unlinked or linked loci (e.g., a haplotype), and that would be expected to transfer the desired genotype, along with a desired phenotype to their progeny. Similarly, by identifying plants lacking the desired allele, plants with an undesirable phenotype, e.g., plants with a non-high oil and/or non-high oleic acid phenotype, or normal oil phenotype (as compared to #2 yellow), can be identified, and, e.g., eliminated from subsequent crosses. It will be appreciated that for the purposes of MAS, the term marker can encompass both marker and QTL loci as both can be used to identify plants with a desired phenotype.

For example, MAS can be used to develop lines or strains of maize and maize germplasm with high oil content and/or high oleic acid content and/or increased oleic acid/linoleic acid ratio by identifying favorable allelic forms of chromosome segments shown to be important, e.g., that include a genetic element, for high oil and/or high oleic acid content. In this manner, the favorable marker loci disclosed herein can be employed as predictors for the high oil trait and/or the high oleic acid trait, and thus be predictors for the high oleic acid/low linoleic acid phenotypic trait (i.e., increased oleic acid/linoleic acid ratio). Briefly, maize plants or germplasm can be selected for one or more favorable marker loci or alleles of favorable marker loci that positively correlate with the high oil and/or high oleic acid content, and/or with increased oleic acid/linoleic acid ratio, without actually raising maize through their life cycle and performing phenotypic evaluations (i.e., measuring for the high oil and/or high oleic content and/or increased oleic acid/linoleic acid ratio). As discussed above, the present invention provides means to identify plants, particularly maize plants, that have an increased oil content and/or an increased oleic acid content and/or increased oleic acid/linoleic acid ratio by identification of plants having a favorable marker locus set forth in SEQ ID NO:2, 4, 6, 8, 10, 12, 14, 16, 18, 20, 22, 24, 26, 28, 30, 32, 34, 36, 38, 40, 42, 44, 46, or 51 with at least one polymorphism therein, for example, the favorable marker locus disclosed in SEQ ID NO:1, 3, 5, 7, 9, 11, 13, 15, 17, 19, 21, 23, 25, 27, 29, 31, 33, 35, 37, 39, 41, 43, 45, or 47 or an allele thereof comprising one or more of the polymorphisms identified therein (see, for example, Table 2 and Table 3 herein below). Similarly, in other embodiments, maize plants can be selected against if they have one or more marker loci that negatively correlate with high oil and/or high oleic acid content and/or increased oleic acid/linoleic acid ratio. In addition, these marker loci can be introgressed into any desired genomic background, germplasm, line, variety, etc., as part of the overall marker-assisted selection program designed to increase oil content and/or oleic acid content, or to increase oleic acid/linoleic acid ratio in maize.

Briefly, in marker-assisted selection, a tissue sample is taken from a first maize plant or a first maize germplasm and is screened to determine if the first maize plant or first maize germplasm comprises an appropriate marker locus or allele thereof that is correlated with high oil content and/or high oleic acid content and/or increased oleic acid/linoleic acid ratio. Maize plants or maize germplasm having the desired marker loci are selected and crossed with a second maize plant or germplasm.

In still other embodiments, the desired marker loci or allele thereof is introgressed into a second maize plant or a second maize germplasm to produce an introgressed maize plant or maize germplasm. In specific embodiments, the introgressed maize plant or germplasm displays an increased oil content, an increased oleic acid content, or an increased oleic acid/linoleic acid ratio when compared to the second maize plant or germplasm.

It will be appreciated that plants positive for one or more favorable marker loci of the invention can be selected and crossed according to any breeding protocol relevant to the particular breeding program. Accordingly, progeny can be generated from a selected plant by crossing the selected plant to one or more additional plants selected on the basis of the same marker or a different marker, e.g., a different marker correlating with high oil content and/or high oleic acid content and/or increased oleic acid/linoleic acid ratio, or a different phentoype of interest, e.g., resistance to a particular disease. Alternatively, a selected plant can be backcrossed to one or both parents. Backcrossing is usually done for the purpose of introgressing one or a few loci from a donor parent, e.g., a donor parent comprising exotic germplasm, into an otherwise desirable genetic background from the recurrent (typically, an elite) parent. The more cycles of backcrossing that are performed, the greater the genetic contribution of the recurrent parent to the resulting variety. A selected plant can also be outcrossed, e.g., to a plant or line not present in its genealogy. Such a plant can be selected from among a population subject to a prior round of analysis, or may be introduced into the breeding program de novo. A plant positive for a desired marker can also be self-crossed ("selfed") to create a true breeding line with the same genotype.

ii. Use of Oleic Acid Content to Monitor and Confirm Presence of QTL6

As noted in the examples herein below, oleic acid concentration shows a larger increase than oil content within maize plants carrying the favorable high-oil/high oleic-acid QTL6 region described herein. This phenotypic trait can be used to monitor and confirm the presence of a favorable marker locus of the invention, and thus predict whether a maize plant or maize germplasm will have the desirable high oil content and/or increased oleic acid/linoleic acid ratio trait.

In some embodiments, the favorable marker locus to be detected is within the polynucleotide encoding DGAT, for example, within the polynucleotide encoding DGAT1-2. In this manner, the favorable marker locus to be detected can comprise a polymorphism in the polynucleotide encoding ZmDGAT1-2 (for example, the coding sequence set forth in SEQ ID NO:51) wherein the polymorphic change to the ZmDGAT1-2 coding sequence results in a glycine residue substitution for the serine residue at the amino acid position corresponding to residue 45 of SEQ ID NO:52; a serine residue substitution for the proline residue at the amino acid position corresponding to residue 55 of SEQ ID NO:52; a deletion of the glutamine residue corresponding to that at amino acid position 64, 65, 66, or 67 of SEQ ID NO:52; and/or an insertion of a phenylalanine residue at a position located between a pair of residues, wherein the pair of residues corresponds to a pair of residues within SEQ ID NO:52 selected from the group consisting of: (a) the tryptophan residue at amino acid position 467 of SEQ ID NO:52 and the phenylalanine residue at amino acid position 468 of SEQ ID NO:52, (b) the phenylalanine residue at amino acid position 468 of SEQ ID NO: 52 and the phenylalanine residue at amino acid position 469 of SEQ ID NO:52, and (c) the phenylalanine residue at amino acid position 469 of SEQ ID NO:52 and the serine residue at amino acid position 470 of SEQ ID NO:52. A non-limiting example of a favorable marker locus within a polynucleotide encoding DGAT1-2 is a sequence comprising the sequence set forth in SEQ ID NO:47, which encodes the ZmDGAT1-2(ASK) protein set forth in SEQ ID NO:48.

Thus, the present invention provides a method for detecting the presence of one or more favorable marker loci of the invention, and thus identifying the presence of the QTL6 region described herein, within a maize plant or maize germplasm, where the method comprises determining the oleic acid concentration of the plant or germplasm, particularly within the seed or embryo. In this manner, a seed or embryo oleic acid concentration of at least 35% (i.e., 35% or more of the seed or embryo oil is represented by oleic acid) would be predictive that the maize plant or maize germplasm likely comprises one or more favorable marker loci of the invention, and thus the desired QTL6 region defined herein, and thus could be beneficially continued in the breeding and selection process. Alternatively, a seed or embryo oleic acid concentration of less than 35% (i.e., oleic acid represents less than 35% of the seed or embryo oil) would be predictive that the maize plant or maize germplasm does not carry the desired QTL6 region within its genome.

This oleic acid screening step could be further supplemented with genomic screens for the presence of one or more favorable marker loci of the QTL6 region described herein, and thus the presence of the desired QTL6 region. In one such example, the presence of the desired QTL6 region is confirmed by detecting the presence of the TTC codon insertion within the ZmDGAT1-2 coding sequence that results in the insertion of $Phe_{467}$, $Phe_{468}$, or $Phe_{469}$ within the ZmDGAT1-2(ASK) protein. This can be achieved, for example, by amplification of a DNA fragment around this codon using SEQ ID NOs:126 and 127, as described in Examples 3 and 13 herein below.

(C) Polynucleotides and/or Polypeptides Associated with QTL6

The present invention provides plants or plant parts having stably incorporated into their genome a heterologous polynucleotide comprising at least one high oil-associated sequence and/or at least one high oleic acid-associated sequence operably linked to a promoter active in the plant or plant part, where the high oil-associated sequence or the high oleic acid-associated sequence is derived from a genomic nucleotide sequence genetically linked to at least one allele of one or more favorable marker loci that are associated with high oil content and/or high oleic acid content and/or increased oleic acid/linoleic acid ratio of a plant or plant part. In some embodiments, the favorable marker loci are genetically linked with a QTL6 region that is flanked by a first border sequence that comprises nucleotides 1-20 of SEQ ID NO:2, and a second border sequence that comprises nucleotides 477-496 of SEQ ID NO:46. In other embodiments, the favorable marker loci are genetically linked with a further defined region of this QTL6 region, where the further defined region is flanked by a first border sequence that comprises nucleotides 1-20 of SEQ ID NO:6, and a second border sequence that comprises nucleotides 482-501 of SEQ ID NO:14. In yet other embodiments, the favorable marker loci are genetically linked with a second further defined region of this QTL6 region, wherein the second further defined region is flanked by a first border sequence that comprises nucleotides 1-20 of SEQ ID NO:10, and a second border sequence that comprises nucleotides 488-507 of SEQ ID NO:4. This second further defined region, which resides within a single gene, DGAT1-2, controls both embryo oil and oleic acid concentrations. It is recognized that the favorable marker loci of the invention can comprise sequences that are non-coding, for example, non-coding RNA that functions without being translated into a protein, also referred to as small RNA (sRNA), including microRNAs (miRNAs), and can comprise coding sequence, for example, an open reading frame, as noted herein above.

In some embodiments, the marker loci comprise a sequence selected from the group consisting of the sequences set forth in SEQ ID NOs:2, 4, 6, 8, 10, 12, 14, 16, 18, 20, 22, 24, 26, 28, 30, 32, 34, 36, 38, 40, 42, 44, 46, and 51 with at least one polymorphism therein that confers or is associated with the high oil content and/or high oleic acid content and/or increased oleic acid/linoleic acid ratio of a plant or plant part thereof. Non-limiting examples of these polymorphisms are disclosed in Table 2 and Table 3 herein below. In some of these embodiments, the favorable marker loci include the marker locus set forth in SEQ ID NO:4 with at least one polymorphism occurring at a nucleotide (nt) position within SEQ ID NO:4 selected from the group consisting of nt 28, 204, 256, 302, 305, 341, 429, 461, and any combination thereof, the marker locus set forth in SEQ ID NO:6 with at least one polymorphism occurring at a nt position within SEQ ID NO:6 selected from the group consisting of nt 43, 74, 208, 224, and any combination thereof, the marker locus set forth in SEQ ID NO:8 with at least one polymorphism occurring at a nt position within SEQ ID NO:8 selected from the group consisting of nt 25, 55, 88, 100, 195, 223, 238, 242, 255, 279, 306, 307, 345, 399, and any combination thereof, the marker locus set forth in SEQ ID NO:10 with at least one polymorphism occurring at a nt position within SEQ ID NO:10 selected from nt 40, 41, 88, 89, 126, 134, 146, 218, and any combination thereof, the marker locus set forth in SEQ ID NO:12 with at least one polymorphism occurring at a nt position within SEQ ID NO:12 selected from nt 128, 195, 256, 257, 293, 294, 295, 296, 327, and any combination thereof, the marker locus set forth in SEQ ID NO:14 with at least one polymorphism occurring at a nt position within SEQ ID NO:14 selected from nt 262, 311, and any combination thereof, the marker locus set forth in SEQ ID NO:16 with at least one polymorphism occurring at nt 428 of SEQ ID NO:16; the marker locus set forth in SEQ ID NO:18 with at least one polymorphism occurring at a nt position within SEQ ID NO:18 selected from nt 119, 396, 420, and any combination thereof, the marker locus set forth in SEQ ID NO:20 with at least one polymorphism occurring at a nt position within SEQ ID NO:20 selected from nt 194, 258, 259, 260, 365, 366, 489, and any combination thereof, the marker locus set forth in SEQ ID NO:22 with at least one polymorphism occurring at a nt position within SEQ ID NO:22 selected from nt 48, 50, 56, 60, 63, 101, 133, 166, 170, 179, 181, 206, 207, 211, 231, 237, 255, 273, 282, 294, 312, 324, 343, 345, 358, 377, 381, 385, 387, 404, and any combination thereof, the marker locus set forth in SEQ ID NO:24 with at least one polymorphism occurring at a nt position within SEQ ID NO:24 selected from nt 358, 359, 371, 421, 422, 423, 425, 426, and any combination thereof, the marker locus set forth in SEQ ID NO:26 with at least one polymorphism occurring at a nt position within SEQ ID NO:26 selected from nt 28, 31, 35, 43, 50, 111, 117, 143, 192, 197, 219, 266, and any combination thereof, the marker locus set forth in SEQ ID NO:28 with at least one polymorphism occurring at a nt position within SEQ ID NO:28 selected from nt 41, 62, 92, 158, 182, 194, 200, 226, 229, 349, and any combination thereof, the marker locus set forth in SEQ ID NO:30 with at least one polymorphism occurring at a nt position within SEQ ID NO:30 selected from nt 102, 145, 162, 165, 198, 199, 221, 247, 251, 253, 306, 331, 352, 451, 461, 464, and any combination thereof, the marker locus set forth in SEQ ID NO:32 with at least one polymorphism occurring at a nt position within SEQ ID NO:32 selected from nt 61, 73, 87, 143, 199, 208, 209, 210, 211, 225, 327, 328, 335, and any combination thereof; and the marker locus set forth in SEQ ID NO:51 with at least one polymorphism occurring at a nt position within SEQ ID NO:51 selected from: nt 134; nt 163; nt 190-192 or 193-195 or 196-198 or 199-201; nt 1401 or 1404 or 1407; and any combination thereof. Exemplary polymorphic changes within these marker loci are set forth in Tables 2 and 3 herein below. In some embodiments, the favorable marker locus comprises the sequence disclosed in SEQ ID NO:1, 3, 5, 7, 9, 11, 13, 15, 17, 19, 21, 23, 25, 27, 29, 31, 33, 35, 37, 39, 41, 43, 45, or 47, or an allele thereof comprising one or more of the polymorphisms identified therein (see, for example, Table 2 and Table 3 herein below).

It is recognized that the stably transformed plants can comprise any one or all of the polynucleotides for the favorable marker loci identified herein. In such embodiments, expression of the heterologous polynucleotide comprising the high oil- or the high oleic acid-associated sequence increases the oil content or the oleic acid content in the plant or plant part, and can favorably increase the oleic acid/linoleic acid ratio within the plant or plant part.

(i) Open Reading Frames of the QTL6 Locus

QTL6 was finely mapped to an approximately 195-kb region that has been characterized and found to contain five open reading frames. Without being bound by theory, one or more of the proteins encoded by these open reading frames are associated with a high-oil phenotype, and/or a high-oleic acid phenotype, and/or a high oleic acid/low linoleic acid phenotype (i.e., increased oleic acid/linoleic acid ratio). Thus, oil content and/or oleic acid content and/or oleic acid/linoleic acid ratio of a plant or plant part thereof can be manipulated by overexpressing one or more of these proteins in the plant or a plant part thereof.

(a) Type-1 Diacylglycerol O-Acyltransferase (DGAT)

The present invention provides a novel variant of a type-1 diacylglycerol O-acyltransferase (DGAT) that, upon expression in a plant or plant part, increases the oil content, increases the oleic acid content, and/or increases the oleic acid/linoleic acid ratio within the plant or plant part, when compared to the DGAT type-1 sequence from a plant that does not exhibit the high oil and/or high oleic acid content and/or high oleic acid/low linoleic acid phenotype, for example, the normal oil maize DGAT1-2 sequence set forth in SEQ ID NO:52 (designated ZmDGAT1-2(EFO9B)). A variant DGAT sequence that increases oil content, increases the oleic acid content, and/or increases the oleic acid/linoleic acid ratio within a plant or plant part in this manner is referred to herein as "a high oil/high oleic acid variant" of DGAT, and the coding sequence for this variant represents a high oil- and high oleic acid-associated sequence of the invention. The term "variant" refers to a protein comprising an amino acid sequence that differs from the amino acid sequence for the reference protein by amino acid deletions, substitutions, or both.

The high oil/high oleic acid variant of DGAT of the present invention designated ZmDGAT1-2(ASK) comprises an amino acid sequence that differs from the reference normal oil maize DGAT1-2 sequence by having a glycine residue substitution for the valine residue at the amino acid position corresponding to residue 45 of SEQ ID NO:52; a serine residue substitution for the proline residue at the amino acid position corresponding to residue 55 of SEQ ID NO:52; a deletion of the glutamine residue corresponding to that at amino acid position 64, 65, 66, or 67 of SEQ ID NO:52; and/or an insertion of a phenylalanine residue at a position located between a pair of residues, wherein the pair of residues corresponds to a pair of residues within SEQ ID NO:52 selected from the group consisting of: (a) the tryptophan residue at amino acid position 467 of SEQ ID NO:52 and the phenylalanine residue at amino acid position 468 of SEQ ID NO:52, (b) the phenylalanine residue at amino acid position 468 of SEQ ID NO: 52 and the phenylalanine residue at amino acid position 469 of SEQ ID NO:52, and (c) the phenylalanine residue at amino acid position 469 of SEQ ID NO:52 and the serine residue at amino acid position 470 of SEQ ID NO:52. See the ZmDGAT1-2(ASK) polypeptide sequence set forth in SEQ ID NO:48. Also see the alignment of the ZmDGAT1-2(ASK) polypeptide with the ZmD- GAT1-2 polypeptide sequence from three normal oil maize inbred lines, EF09B, Mo17, and B73, shown in FIG. 30. An alignment of the respective coding sequences is shown in FIG. 31. The high oil/high oleic acid DGAT variant of the invention can have one or more of these various modifications. As used herein, the reference amino acid sequence for maize DGAT1-2 from normal oil maize inbred lines is shown in SEQ ID NO:52 (sequence for ZmDGAT1-2(EF09B)), which is encoded by a nucleotide sequence such as that set forth in SEQ ID NO:51.

One or more of the particular substitutions disclosed herein result in a DGAT variant that retains the desired activities of allowing for an increase in oil and/or oleic acid levels, and/or an increase in the oleic acid/linoleic acid ratio of a plant or plant part thereof, when compared to an appropriate control plant or plant part, as described elsewhere herein. Having identified the positions within the high oil/high oleic acid DGAT sequence (i.e., ZmDGAT1-2(ASK) sequence) and the relevant substitutions, deletions, and insertions, it is within the skill of one in the art to vary other residues within the DGAT variant sequence to obtain variants of the high oil/high oleic acid DGAT disclosed herein that also retain the desired activity, i.e., increasing oil content and/or increasing oleic acid content, and/or increasing oleic acid/linoleic acid ratio of a plant or plant part thereof. Such variants of the high oil/high oleic acid DGAT variant disclosed herein are also intended to be encompassed by the present invention, and are further defined below. The present invention also provides any nucleotide sequences encoding the high oil/high oleic acid DGAT variants of the invention, for example, the coding sequence set forth in SEQ ID NO:47, which encodes the ZmDGAT1-2(ASK) high oil/high oleic acid DGAT variant (SEQ ID NO:48).

Diacylglycerol acyltransferases (DGAT, EC 2.3.1.20) use fatty acyl CoA and diacylglycerol as substrates to catalyze the committed step in triacylglycerol synthesis. DGATs plays a fundamental role in the metabolism of cellular glycerolipids. Many members of the DGAT family have been identified in plants, several of which are shown in an alignment in FIG. 33. The high oil/high oleic acid DGAT of the instant invention (ZmDGAT1-2(ASK)) is also shown in FIG. 33. Phylogenic analysis (see FIG. 32) of these DGAT polypeptides was performed using PHYLIP program (J. Felsenstein, University of Washington) and displayed using TreeView program (Page (1996) *Computer Appl. Biosci.* 12:357-358). Plant type I and type II diacylglycerol acyltransferases, glycerol-3-phosphate acyltransferases (GPAT) and lysophosphatidyl acyltransferases (LPAT) were included in the analysis. Results show that type 1 DGAT (DGAT1) is distinct from type 2 DGAT (DGAT2), GPAT, and LPAT. Within type 1 DGAT, a subgroup, DGAT1-2 composed of several monocot species can be further differentiated. The DGAT ORF located within the QTL6 region of the invention is a member of the DGAT1-2 subgroup.

Also provided herein is the normal oil ZmDGAT1-2 polypeptide as identified in the normal oil maize inbred lines EF09B, Mo17, and B73. For purposes of the present invention, this polypeptide is referred to herein as the "normal oil" ZmDGAT1-2 or ZmDAGT1-2(EF09B), ZmDGAT1-2 (Mo17), or ZmDGAT1-2(B73), depending upon the normal oil maize inbred line from which the normal oil ZmDGAT1-2 polypeptide was derived. The normal oil ZmDGAT1-2 polypeptide is set forth in SEQ ID NO:50 (referred to as ZmDGAT1-2(Mo17), SEQ ID NO:52 (referred to as ZmDGAT1-2(EF09B), and SEQ ID NO:54 (referred to herein as ZmDGAT1-2(B73)). Polynucleotides encoding the normal oil ZmDGAT1-2 polypeptide are also encompassed by the present invention. Exemplary polynucleotides are set forth in SEQ ID NO:49 (referred to as ZmDGAT1-2(Mo17) coding sequence), SEQ ID NO:51 (referred to as ZmDGAT1-2 (EF09B coding sequence), and SEQ ID NO:53 (referred to as ZmDGAT1-2(B73)). As noted above, for purposes of comparing polymorphic changes between the high oil/high oleic acid ZmDGAT1-2(ASK) coding and polypeptide sequences and the respective normal oil ZmDGAT1-2 coding and polypeptide sequences, ZmDGAT1-2(EF09B) serves as the reference normal oil ZmDGAT1-2 (i.e., the amino acid sequence set forth in SEQ ID NO:52, and the exemplary coding sequence set forth in SEQ ID NO:51). Variants of the normal oil ZmDGAT1-2 polypeptide and polynucleotides encoding these variants are also encompassed by the present invention.

The normal oil ZmDGAT1-2 polypeptide and sequences encoding this protein, and variants thereof that retain the activity of the normal oil ZmDGAT1-2 protein, and thus are involved in oil biosynthesis, also find use in increasing oil and/or oleic acid content and/or increasing oleic acid/linoleic acid ratio in accordance with the methods of the present invention. In this manner, overexpression of the normal oil ZmDGAT1-2 polypeptide, or functional fragments and variants thereof as defined elsewhere herein, can provide for increased oil content, increased oleic acid content, and/or increased oleic acid/linoleic acid ratio in a plant or plant part thereof, as described herein below. See also Example 11 below.

(b) Amino Acid Permease

The present invention also provides the open reading frame for the maize amino acid permease 1 (AAP1) polypeptide (SEQ ID NO:56; designated ZmAAP1) and biologically active variants thereof as defined herein below. Isolated polynucleotides encoding the ZmAAP1 polypeptide are also encompassed by the present invention. In one such embodiment, the isolated polynucleotide comprises the sequence set forth in SEQ ID NO:55 or variant thereof encoding a biologically active AAP1 polypeptide. FIG. 34 shows an alignment of the ZmAAP1 polypeptide with other related AAP polypeptides from other plant species. For a review of amino acid permeases in amino acid transport, in general, see, for example, Wipf et al. (2002) *Trends Biochem. Sci.* 27(3): 139-147.

(c) K+ Efflux System Protein (PESP)

The present invention also provides the open reading frame for the maize potassium efflux system protein (SEQ ID NO:58; designated ZmPESP) and biologically active variants thereof as defined herein below. Isolated polynucleotides encoding the ZmPESP polypeptide are also encompassed by the present invention. In one such embodiment, the isolated polynucleotide comprises the sequence set forth in SEQ ID NO:57 or variant thereof encoding a biologically active PESP polypeptide. FIG. 35 shows an alignment of the ZmPESP polypeptide with other related PESP polypeptides from other plant species. For a review of PESP polypeptides, in general, see, for example, Ferguson et al. (1993) *Mol. Microbiol.* 9(6):1297-1303.

(d) 40S Ribosomal Protein S24

The present invention also provides the open reading frame for the maize 40S ribosomal protein S24 (SEQ ID NO:60; designated ZmS24) and biologically active variants thereof as defined herein below. Isolated polynucleotides encoding the ZmS24 polypeptide are also encompassed by the present invention. In one such embodiment, the isolated polynucleotide comprises the sequence set forth in SEQ ID NO:59 or variant thereof encoding a biologically active 40S ribosomal protein S24. FIG. 36 shows an alignment of the ZmS24 polypeptide with other related ribosomal proteins from other plant species. For a review of ribosomal S24 polypeptides, in general, see, for example, Xu and Roufa (1996) *Gene* 169: 257-262.

(e) ABC Transporter

The present invention also provides the open reading frame for a maize PDR-like ABC transporter (ABCT) polypeptide (composite sequence shown in SEQ ID NO:64; designated ZmABCT (Composite) herein) and biologically active variants thereof as defined herein below. Isolated polynucleotides encoding the ZmABCT (Composite) polypeptide are also encompassed by the present invention. In one such embodiment, the isolated polynucleotide comprises the sequence set forth in SEQ ID NO:63 or variant thereof encoding a biologically active ABCT polypeptide.

The full-length coding sequence was constructed from the ZmABCT partial ORF cDNA sequence cloned from the non-high oil, non-high oleic acid Mo17 inbred maize line (sequence set forth in SEQ ID NO:61, encoding the N-terminal amino acid sequence set forth in SEQ ID NO:62) and the EST and genomic sequence for the non-high oil, non-high oleic acid B73 inbred maize line. FIG. 37 shows an alignment of the ZmABCT (Composite) polypeptide with other related ABCT polypeptides from other plant species. For a review of ABCT polypeptides, in general, see, for example, Van den Brule and Smart (2002) *Planta* 216:95-106.

(C) Variants and Fragments

The invention encompasses isolated or substantially purified polynucleotide or protein compositions. An "isolated" or "purified" polynucleotide or protein, or biologically active portion thereof, is substantially or essentially free from components that normally accompany or interact with the polynucleotide or protein as found in its naturally occurring environment. Thus, an isolated or purified polynucleotide or protein is substantially free of other cellular material, or culture medium when produced by recombinant techniques, or substantially free of chemical precursors or other chemicals when chemically synthesized. Optimally, an "isolated" polynucleotide is free of sequences (optimally protein encoding sequences) that naturally flank the polynucleotide (i.e., sequences located at the 5' and 3' ends of the polynucleotide) in the genomic DNA of the organism from which the polynucleotide is derived. For example, in various embodiments, the isolated polynucleotide can contain less than about 5 kb, 4 kb, 3 kb, 2 kb, 1 kb, 0.5 kb, or 0.1 kb of nucleotide sequence that naturally flank the polynucleotide in genomic DNA of the cell from which the polynucleotide is derived. A protein that is substantially free of cellular material includes preparations of protein having less than about 30%, 20%, 10%, 5%, or 1% (by dry weight) of contaminating protein. When the protein of the invention or biologically active portion thereof is recombinantly produced, optimally culture medium represents less than about 30%, 20%, 10%, 5%, or 1% (by dry weight) of chemical precursors or non-protein-of-interest chemicals.

Fragments and variants of the disclosed polynucleotides and any proteins encoded thereby are also encompassed by the present invention. By "fragment" is intended a portion of the polynucleotide, for example, a portion of the polynucleotide for the marker locus comprising the sequence set forth in SEQ ID NO:1, 3, 5, 7, 9, 11, 13, 15, 17, 19, 21, 23, 25, 27, 29, 31, 33, 35, 37, 39, 41, 43, 45, or, in the case of a protein of the invention, a portion of the amino acid sequence and hence protein encoded thereby.

Where the polynucleotide of the invention comprises an open reading frame, for example, a polynucleotide encoding the high oil/high oleic acid ZmDGAT1-2(ASK), normal oil ZmDGAT1-2, ZmAAP1, ZmPESP, ZmS24, or ZmABCT (Composite) polypeptide, such as, for example, the polynucleotide set forth in SEQ ID NO:47, 51, 55, 57, 59, or 63, respectively, a fragment of the polynucleotide may encode protein fragments that retain the biological activity of the full-length polypeptide, and hence increase oil content and/or increase oleic acid content and/or increase oleic acid/linoleic acid ratio in a plant or plant part thereof when compared to an appropriate control plant or plant part thereof. Alternatively, fragments of a polynucleotide that comprises a coding sequence and which are useful as hybridization probes generally do not encode fragment proteins retaining biological activity. Thus, fragments of a nucleotide sequence may range from at least about 10 nucleotides, about 20 nucleotides, about 50 nucleotides, about 100 nucleotides, and up to the full-length polynucleotide disclosed herein, depending upon the intended use of the polynucleotide.

Thus, for example, where the polynucleotide represents non-coding sequence, for example, a marker locus comprising the sequence set forth in SEQ ID NO:1, 3, 5, 7, 9, 11, 13, 15, 17, 19, 21, 23, 25, 27, 29, 31, 33, 35, 37, 39, 41, 43, or 45, a fragment of the polynucleotide can comprise at least 12, 16, 20, 50, 75, 100, 150, 200, or 250 contiguous nucleotides, or up to the number of nucleotides present in a full-length nucleotide sequence for a favorable marker locus disclosed herein (for example, 523, 507, 257, 511, 241, 371, 510, 592, 550, 520, 464, 514, 505, 410, 522, 507, 553, 972, 469, 413, 457, 762, or 499 nucleotides for SEQ ID NO:1, 3, 5, 7, 9, 11, 13, 15, 17, 19, 21, 23, 25, 27, 29, 31, 33, 35, 37, 39, 41, 43, or 45, respectively). Fragments of a favorable marker locus having a sequence that is non-coding sequence will comprise at least one of the polymorphisms identified herein. Thus, for example, a fragment of a marker locus comprising the sequence set forth in SEQ ID NO:1, 3, 5, 7, 9, 11, 13, 15, 17, 19, 21, 23, 25, 27, 29, 31, 33, 35, 37, 39, 41, 43, or 45 comprises a portion of the nucleotide sequence that comprises at least one of the polymorphisms identified therein; see, for example, Table 2 below and the alignments provided in FIGS. 7-29 herein.

A fragment of a polynucleotide that encodes a biologically active portion of a high oil/high oleic acid DGAT (for example, ZmDGAT1-2(ASK)), a normal oil DGAT (for example, ZmDGAT1-2(EF09B)), an amino acid permease, a PESP, a ribosomal protein, or an ABC transporter protein of the invention will encode at least 15, 25, 30, 50, 100, 150, 200, 250, 300, 350, 400, 450, 500, 550, 650, 700 contiguous amino acids, or up to the total number of amino acids present in a full-length high oil/high oleic acid DGAT, normal oil DGAT, amino acid permease, PESP, ribosomal protein, or ABC transporter protein of the invention. Fragments of a polynucleotide that are useful as hybridization probes or PCR primers generally need not encode a biologically active portion of a high oil/high oleic acid DGAT, a normal oil DGAT, an amino acid permease, a PESP, a ribosomal protein, or an ABC transporter protein.

Thus, a fragment of a polynucleotide of the invention may encode a biologically active portion of a high oil/high oleic acid DGAT, a normal oil DGAT, an amino acid permease, a PESP, a ribosomal protein, or an ABC transporter protein, or it may be a fragment that can be used as a hybridization probe or PCR primer using methods disclosed below. A biologically active portion of a high oil/high oleic acid DGAT, a normal oil DGAT, an amino acid permease, a PESP, a ribosomal protein, or an ABC transporter protein can be prepared by isolating a portion of one of the respective polynucleotides encoding these proteins, expressing the encoded portion of the high oil/high oleic acid DGAT, the normal oil DGAT, the amino acid permease, the PESP, the ribosomal protein, or the ABC transporter protein (e.g., by recombinant expression in vitro), and assessing the activity of the encoded portion of the respective protein. Polynucleotides that are fragments of a nucleotide sequence encoding a high oil/high oleic acid DGAT, a normal oil DGAT, an amino acid permease, a PESP, a ribosomal protein, or an ABC transporter protein comprise at least 16, 20, 50, 75, 100, 150, 200, 250, 300, 350, or 400 contiguous nucleotides, or up to the number of nucleotides present in a full-length nucleotide sequence encoding a high oil/high oleic acid DGAT, a normal oil DGAT, an amino acid permease, a PESP, a ribosomal protein, or an ABC transporter protein disclosed herein (for example, 1485, 1485, 1389, 1896, 414, and 4710 nucleotides for SEQ ID NOS:47, 51, 55, 57, 59, and 63, respectively).

In some embodiments, the polynucleotide encodes a fragment of the ZmDGAT1-2(ASK) polypeptide set forth in SEQ ID NO:48, where the fragment comprises at least one of the glycine residue at amino acid position 45 of SEQ ID NO:48, the serine residue at amino acid position 55 of SEQ ID NO:48, and the phenylalanine residue at amino acid position 467, 468, or 469 of SEQ ID NO:48, wherein expression of the encoded polypeptide fragment in a plant or plant part thereof increases the oil content, increases the oleic acid content, and/or increases the oleic acid/linoleic acid ratio within the plant or plant part thereof.

In other embodiments, the polynucleotide encodes a fragment of the normal oil ZmDGAT1-2 polypeptide set forth in SEQ ID NO:52 with at least one alteration selected from the group consisting of: (a) a substitution of a glycine residue for the valine residue at amino acid position 45 of SEQ ID NO:52; (b) a serine residue for the proline residue at amino acid position 55 of SEQ ID NO:52; (c) a deletion of the glutamine residue corresponding to that at amino acid position 64, 65, 66, or 67 of SEQ ID NO:52; and (d) an insertion of a phenylalanine residue at a position located between a pair of residues, wherein the pair of residues corresponds to a pair of residues within SEQ ID NO:52 selected from the group consisting of: (i) the tryptophan residue at amino acid position 467 of SEQ ID NO:52 and the phenylalanine residue at amino acid position 468 of SEQ ID NO:52, (ii) the phenylalanine residue at amino acid position 468 of SEQ ID NO: 52 and the phenylalanine residue at amino acid position 469 of SEQ ID NO:52, and (iii) the phenylalanine residue at amino acid position 469 of SEQ ID NO:52 and the serine residue at amino acid position 470 of SEQ ID NO:52; wherein expression of the encoded polypeptide fragment in a plant or plant part thereof increases the oil content, increases the oleic acid content, and/or increases the oleic acid/linoleic acid ratio within the plant or plant part thereof.

In yet other embodiments, the fragment of a polynucleotide encodes a fragment of the normal oil ZmDGAT1-2 polypeptide set forth in SEQ ID NO:52 (setting forth ZmDGAT1-2 (EF09B), which has the same sequence as the ZmDGAT1-2 (Mo17) and ZmDGAT1-2(B73) polypeptides respectively set forth in SEQ ID NOS:50 and 54), wherein overexpression of the encoded polypeptide fragment in a plant or plant part thereof increases the oil content, increases the oleic acid content, and/or increases the oleic acid/linoleic acid ratio within the plant or plant part thereof.

"Variants" is intended to mean substantially similar sequences. For polynucleotides, a variant comprises a deletion and/or addition of one or more nucleotides at one or more internal sites within the native polynucleotide and/or a substitution of one or more nucleotides at one or more sites in the native polynucleotide. As used herein, a "native" polynucleotide or polypeptide comprises a naturally occurring nucleotide sequence or amino acid sequence, respectively.

Where the polynucleotide represents non-coding sequence, for example, a favorable marker locus comprising the sequence set forth in SEQ ID NO:1, 3, 5, 7, 9, 11, 13, 15, 17, 19, 21, 23, 25, 27, 29, 31, 33, 35, 37, 39, 41, 43, or 45, a variant of the favorable marker locus will comprise a nucleotide sequence comprising at least one of the polymorphisms identified within the sequence for the respective marker locus (see, for example, Table 2 and the alignments presented in FIGS. 7-29 herein) and will retain the characteristic of being associated with the high oil and/or high oleic acid and/or high oleic acid/low linoleic acid (i.e., increased oleic acid/linoleic acid ratio) phenotypic trait. For polynucleotides that encode a protein of the invention, conservative variants include those sequences that, because of the degeneracy of the genetic code, encode the amino acid sequence of the high oil/high oleic acid DGAT, normal oil DGAT, amino acid permease, PESP, ribosomal protein, or ABC transporter protein of the invention. Naturally occurring allelic variants such as these can be identified with the use of well-known molecular biology techniques, as, for example, with polymerase chain reaction (PCR) and hybridization techniques as outlined below. Variant polynucleotides also include synthetically derived polynucleotides, such as those generated, for example, by using site-directed mutagenesis, and, for coding sequences, still encode the amino acid sequence of the high oil/high oleic acid DGAT, normal oil DGAT, amino acid permease, PESP, ribosomal protein, or ABC transporter protein of the invention. Generally, variants of a particular polynucleotide of the invention will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to that particular polynucleotide as determined by sequence alignment programs and parameters described elsewhere herein.

Variants of a particular polynucleotide of the invention (i.e., the reference polynucleotide) that encode a polypeptide of the invention can also be evaluated by comparison of the percent sequence identity between the polypeptide encoded by a variant polynucleotide and the polypeptide encoded by the reference polynucleotide. Thus, for example, an isolated polynucleotide that encodes a polypeptide with a given percent sequence identity to the polypeptide of SEQ ID NO:48, 52, 56, 58, 60, and 64 are disclosed. Percent sequence identity between any two polypeptides can be calculated using sequence alignment programs and parameters described elsewhere herein. Where any given pair of polynucleotides of the invention is evaluated by comparison of the percent sequence identity shared by the two polypeptides they encode, the percent sequence identity between the two encoded polypeptides is at least about 40%, 45%, 50%, 55%, 60%, 65%, 70%, 75%, 80%, 85%, 90%, 91%, 92%, 93%, 94%, 95%, 96%, 97%, 98%, 99% or more sequence identity.

"Variant" protein is intended to mean a protein derived from the native protein by deletion or addition of one or more amino acids at one or more internal sites in the native protein and/or substitution of one or more amino acids at one or more sites in the native protein. Variant proteins encompassed by the present invention are biologically active, that is they continue to possess the desired biological activity of the naturally occurring protein, that is, the desired biological activity of the ZmDGAT1-2(ASK) protein, the normal oil ZmDGAT1-2 protein (for example, ZmDGAT1-2(EF09B), the ZmAAP1 protein, the ZmPESP, the ZmS24 protein, and the ZmABCT protein as described herein. Such variants may result from, for example, one or more genetic polymorphisms or from human manipulation. Biologically active variants of a naturally occurring high oil/high oleic acid DGAT of the invention, such as ZmDGAT1-2(ASK), normal oil DGAT of the invention, such as ZmDGAT1-2(EF09B), amino acid permease of the invention, such as ZmAAP1, PESP of the invention, such as ZmPESP, ribosomal protein of the invention, such as ZmS24, or ABC transporter protein of the invention, such as ZmABCT, will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to the amino acid sequence for the native protein as determined by sequence alignment programs and parameters described elsewhere herein. A biologically active variant of a protein of the invention may differ from that protein by as few as 1-15 amino acid residues, as few as 1-10, such as 6-10, as few as 5, as few as 4, 3, 2, or even 1 amino acid residue.

The proteins of the invention may be altered in various ways including amino acid substitutions, deletions, truncations, and insertions. Methods for such manipulations are generally known in the art. For example, amino acid sequence variants and fragments of the ZmDGAT1-2(ASK) protein, the normal oil ZmDGAT1-2 protein (for example, ZmDGAT1-2(EF09B)), the ZmAAP1 protein, the ZmPESP, the ZmS24 protein, and the ZmABCT protein can be prepared by mutations in the DNA. Methods for mutagenesis and polynucleotide alterations are well known in the art. See, for example, Kunkel (1985) *Proc. Natl. Acad. Sci. USA* 82:488-492; Kunkel et al. (1987) *Methods in Enzymol.* 154:367-382; U.S. Pat. No. 4,873,192; Walker and Gaastra, eds. (1983) *Techniques in Molecular Biology* (MacMillan Publishing Company, New York) and the references cited therein. Guidance as to appropriate amino acid substitutions that do not affect biological activity of the protein of interest may be found in the model of Dayhoff et al. (1978) *Atlas of Protein Sequence and Structure* (Natl. Biomed. Res. Found., Washington, D.C.), herein incorporated by reference. Conservative substitutions, such as exchanging one amino acid with another having similar properties, may be optimal.

Thus, the genes and polynucleotides of the invention include both the naturally occurring sequences as well as mutant forms. Likewise, the proteins of the invention encompass both naturally occurring proteins as well as variations and modified forms thereof. Such variants will continue to possess the desired activity. Thus, for example, variants of the ZmDGAT1-2(ASK) protein will continue to confer the high-oil/high-oleic acid phenotype in a plant or plant part thereof. Variants of the normal oil ZmDGAT1-2 protein (for example, ZmDGAT1-2(EF09B)) will continue to possess the desired activity of being involved in oil biosynthesis, and thus when overexpressed in a plant or plant part, result in an increase in the oil content, the oleic acid content, and/or the oleic acid/linoleic acid ratio of that plant or plant part. Obviously, the mutations that will be made in the DNA encoding the variant must not place the sequence out of reading frame and optimally will not create complementary regions that could produce secondary mRNA structure. See, EP Patent Application Publication No. 75,444.

The deletions, insertions, and substitutions of the protein sequences encompassed herein are not expected to produce radical changes in the characteristics of the protein. However, when it is difficult to predict the exact effect of the substitution, deletion, or insertion in advance of doing so, one skilled in the art will appreciate that the effect will be evaluated by routine screening assays.

Variant polynucleotides and proteins also encompass sequences and proteins derived from a mutagenic and recombinogenic procedure such as DNA shuffling. With such a procedure, one or more different coding sequences for the ZmDGAT1-2(ASK) protein, the normal oil ZmDGAT1-2 protein (for example, ZmDGAT1-2(EF09B)), the ZmAAP1 protein, the ZmPESP, the ZmS24 protein, or the ZmABCT protein coding sequences can be manipulated to create a new DGAT1-2 protein, AAP1 protein, PESP, 40S ribosomal S24 protein, or ABCT protein possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between the coding sequence for the ZmDGAT1-2(ASK), the normal oil ZmDGAT1-2 (for example, ZmDGAT1-2(EF09B)), ZmAAP1, ZmPESP, ZmS24, or ZmABCT protein of the invention and coding sequences for other known respective DGAT1-2, AAP1, PESP, S24, ABCT proteins to obtain a new gene coding for a protein with an improved property of interest. Strategies for such DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J. Mol. Biol.* 272:336-347; Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458.

The compositions of the invention also include isolated nucleic acid molecules comprising the ZmDGAT1-2(Mo17) promoter nucleotide sequence (complementary strand set forth in SEQ ID NO:119); the ZmDGAT1-2(ASK) promoter nucleotide sequence (complementary strand set forth in SEQ ID NO:130); the ZmAAP1 promoter nucleotide sequence (set forth in SEQ ID NO:120); the ZmPESP(Mo17) promoter nucleotide sequence (set forth in SEQ ID NO:121); the ZmPESP(ASK) promoter nucleotide sequence (set forth in SEQ ID NO:129); the ZmS24 promoter nucleotide sequence (set forth in SEQ ID NO:122); and the ZmABCT promoter sequence (set forth in SEQ ID NO:123). By "promoter" is intended a regulatory region of DNA usually comprising a TATA box capable of directing RNA polymerase II to initiate RNA synthesis at the appropriate transcription initiation site for a particular coding sequence. A promoter may additionally comprise other recognition sequences generally positioned upstream or 5' to the TATA box, referred to as upstream promoter elements, which influence the transcription initiation rate.

It is recognized that having identified the nucleotide sequence for the respective promoter regions disclosed herein, it is within the state of the art to isolate and identify additional regulatory elements in the 5'-untranslated region upstream from the particular promoter region defined herein. Thus for example, the respective promoter regions disclosed herein may further comprise upstream regulatory elements that confer tissue-preferred expression of heterologous nucleotide sequences operably linked to the disclosed promoter sequence. See particularly, Australian Patent No. AU-A-77751/94 and U.S. Pat. Nos. 5,466,785 and 5,635,618.

Fragments and variants of the disclosed ZmDGAT1-2 (Mo17), AmDGAT1-2(ASK), ZmAAP1, ZmPESP(Mo17), ZmPESP(ASK), ZmS24, and ZmABCT promoter nucleotide sequences are also encompassed by the present invention. By "fragment" of a promoter sequence is intended a portion of the promoter nucleotide sequence. Fragments of a promoter nucleotide sequence may retain biological activity and hence retain their transcriptional regulatory activity. Thus, for example, less than the entire promoter sequence disclosed herein may be utilized to drive expression of an operably linked nucleotide sequence of interest, such as a nucleotide sequence encoding a heterologous protein. Alternatively, fragments of a promoter nucleotide sequence that are useful as hybridization probes generally do not retain biological activity. Thus, fragments of a promoter nucleotide sequence may range from at least about 20 nucleotides, about 50 nucleotides, about 100 nucleotides, and up to the full-length promoter nucleotide sequence of the invention.

Thus, a fragment of the disclosed ZmDGAT1-2 (Mo17), ZmDGAT1-2(ASK), ZmAAP1, ZmPESP(Mo17), ZmPESP (ASK), ZmS24, or ZmABCT promoter nucleotide sequence may encode a biologically active portion of the respective promoter, or it may be a fragment that can be used as a hybridization probe or PCR primer using methods disclosed below. A biologically active portion of the disclosed ZmDGAT1-2 (Mo17), ZmDGAT1-2(ASK), ZmAAP1, ZmPESP (Mo17), ZmPESP(ASK), ZmS24, or ZmABCT promoter can be prepared by isolating a portion of the respective promoter nucleotide sequence of the invention, and assessing the activity of the portion of the respective promoter. Nucleic acid molecules that are fragments of a ZmDGAT1-2 (Mo17), ZmDGAT1-2(ASK), ZmAAP1, ZmPESP(Mo17), ZmPESP (ASK), ZmS24, or ZmABCT promoter nucleotide sequence comprise at least 16, 20, 50, 75, 100, 150, 200, 250, 300, 350, 400, 450 nucleotides, or up to the number of nucleotides present in a full-length ZmDGAT1-2 (Mo17), ZmDGAT1-2 (ASK), ZmAAP1, ZmPESP(Mo17), ZmPESP(ASK), ZmS24, or ZmABCT promoter nucleotide sequence disclosed herein (for example, up to 3000 nucleotides for the ZmDGAT1-2(Mo17) promoter, the complementary sequence of which is shown in SEQ ID NO:119; up to 3000 nucleotides for the AmDGAT1-2(ASK) promoter, the complementary sequence of which is shown in SEQ ID NO:130; up to 728 nucleotides for the ZmAAP1 promoter shown in SEQ ID NO:120; up to 3000 nucleotides for the ZmPESP(Mo17) promoter shown in SEQ ID NO:121); up to 3000 nucleotides for the ZmPESP(ASK) promoter shown in SEQ ID NO:129); up to 3000 bp for the ZmS24 promoter shown in SEQ ID NO:122); and up to 728 nucleotides for the ZmABCT promoter shown in SEQ ID NO:123). Assays to determine the activity of a promoter sequence are well known in the art. For example, a ZmDGAT1-2 (Mo17) promoter fragment or variant may be operably linked to the nucleotide sequence encoding any reporter protein, such as the β-glucuronidase protein (GUS reporter) or the luciferase protein. The DNA construct is inserted into the genome of a plant or plant cell, and the mRNA or protein level of the reporter sequence is determined. See, for example, Eulgem et al. (1999) *EMBO Journal* 18: 4689-4699.

The polynucleotides of the invention can be used to isolate corresponding sequences from other organisms, particularly other plants, more particularly other monocots. In this manner, methods such as PCR, hybridization, and the like can be used to identify such sequences based on their sequence homology to the sequences set forth herein. Sequences isolated based on their sequence identity to the entire sequence of a marker locus disclosed herein, including the five open reading frames for the QTL6 region disclosed herein, to a normal oil DGAT disclosed herein (for example, ZmDGAT1-2(EF09B)), or to variants and fragments thereof, are encompassed by the present invention. Such sequences include sequences that are orthologs of the disclosed sequences. "Orthologs" is intended to mean genes derived from a common ancestral gene and which are found in different species as a result of speciation. Genes found in different species are considered orthologs when their nucleotide sequences and/or their encoded protein sequences share at least 60%, 70%, 75%, 80%, 85%, 90%, 91%, 92%, 93%, 94%, 95%, 96%, 97%, 98%, 99%, or greater sequence identity. Functions of orthologs are often highly conserved among species. Thus, isolated polynucleotides that encode for a DGAT1-2 protein, an AAP1 protein, a PESP, a 40S ribosomal S24 protein, or an ABCT protein, and which hybridize under stringent conditions to the respective sequences disclosed herein as SEQ ID NOs:47 or 51 (ZmDGAT1-2(ASK) and ZmDGAT1-2 (EF09B), respectively), 55, 57, 59, and 63, or to variants or fragments thereof, or any complement thereof, are encompassed by the present invention. Similarly, isolated polynucleotides that confer promoter activity, and which hybridize under stringent conditions to the complement of the respective promoter sequences disclosed herein as SEQ ID NOS:120, 121, 122, 123, 129, and the complement of SEQ ID NO:119 or the complement of SEQ ID NO:130, or to variants or fragments thereof, or to any complement thereof, are encompassed by the present invention.

In a PCR approach, oligonucleotide primers can be designed for use in PCR reactions to amplify corresponding DNA sequences from cDNA or genomic DNA extracted from any plant of interest. Methods for designing PCR primers and PCR cloning are generally known in the art and are disclosed in Sambrook et al. (1989) *Molecular Cloning: A Laboratory Manual* (2d ed., Cold Spring Harbor Laboratory Press, Plainview, N.Y.). See also Innis et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially mismatched primers, and the like.

In hybridization techniques, all or part of a known polynucleotide is used as a probe that selectively hybridizes to other corresponding polynucleotides present in a population of cloned genomic DNA fragments or cDNA fragments (i.e., genomic or cDNA libraries) from a chosen organism. The hybridization probes may be genomic DNA fragments, cDNA fragments, RNA fragments, or other oligonucleotides, and may be labeled with a detectable group such as $^{32}$P, or any other detectable marker. Thus, for example, probes for hybridization can be made by labeling synthetic oligonucleotides based on the polynucleotides for the favorable marker loci of the invention, including SEQ ID NOs:1, 3, 5, 7, 9, 11, 13, 15, 17, 19, 21, 23, 25, 27, 29, 31, 33, 35, 37, 39, 41, 43, and 45, as well as the open-readings frames set forth in SEQ ID NOs:47, 51, 55, 57, 59, and 63. Methods for preparation of probes for hybridization and for construction of cDNA and genomic libraries are generally known in the art and are disclosed in Sambrook et al. (1989) *Molecular Cloning: A Laboratory Manual* (2d ed., Cold Spring Harbor Laboratory Press, Plainview, N.Y.).

For example, the entire ZmDGAT1-2(ASK) polynucleotide disclosed herein as SEQ ID NO:47, or one or more portions thereof, or the entire ZmDGAT1-2(EF09B) polynucleotide disclosed herein as SEQ ID NO:51, or one or more portions thereof, may be used as a probe capable of specifically hybridizing to corresponding DGAT1-2 polynucleotides and messenger RNAs. To achieve specific hybridization under a variety of conditions, such probes include sequences that are unique among DGAT1-2 polynucleotide sequences and are optimally at least about 10 nucleotides in length, and most optimally at least about 20 nucleotides in length. Such probes may be used to amplify corresponding DGAT1-2 polynucleotides, particularly DGAT1-2 polynucleotides having one or more of the polymorphisms identified in SEQ ID NO:47, or DGAT-12 polynucleotides encoding variants of the normal oil DGAT1-2 protein of the invention, from a chosen plant by PCR. This technique may be used to isolate additional coding sequences from a desired plant or as a diagnostic assay to determine the presence of coding sequences in a plant. Hybridization techniques include hybridization screening of plated DNA libraries (either plaques or colonies; see, for example, Sambrook et al. (1989) *Molecular Cloning: A Laboratory Manual* (2d ed., Cold Spring Harbor Laboratory Press, Plainview, N.Y.).

Hybridization of such sequences may be carried out under stringent conditions. By "stringent conditions" or "stringent hybridization conditions" is intended conditions under which a probe will hybridize to its target sequence to a detectably greater degree than to other sequences (e.g., at least 2-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of similarity are detected (heterologous probing). Generally, a probe is less than about 1000 nucleotides in length, optimally less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours. The duration of the wash time will be at least a length of time sufficient to reach equilibrium.

Specificity is typically the function of post-hybridization washes, the critical factors being the ionic strength and temperature of the final wash solution. For DNA-DNA hybrids, the $T_m$ can be approximated from the equation of Meinkoth and Wahl (1984) *Anal. Biochem.* 138:267-284: $T_m$=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization, and/or wash conditions can be adjusted to hybridize to sequences of the desired identity. For example, if sequences with ≧90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution), it is optimal to increase the SSC concentration so that a higher temperature can be used. An extensive guide to the hybridization of nucleic acids is found in Tijssen (1993) *Laboratory Techniques in Biochemistry and Molecular Biology—Hybridization with Nucleic Acid Probes*, Part I, Chapter 2 (Elsevier, N.Y.); and Ausubel et al., eds. (1995) *Current Protocols in Molecular Biology*, Chapter 2 (Greene Publishing and Wiley-Interscience, New York). See Sambrook et al. (1989) *Molecular Cloning: A Laboratory Manual* (2d ed., Cold Spring Harbor Laboratory Press, Plainview, N.Y.).

The following terms are used to describe the sequence relationships between two or more polynucleotides or polypeptides: (a) "reference sequence", (b) "comparison window", (c) "sequence identity", and, (d) "percentage of sequence identity."

(a) As used herein, "reference sequence" is a defined sequence used as a basis for sequence comparison. A reference sequence may be a subset or the entirety of a specified sequence; for example, as a segment of a full-length cDNA or gene sequence, or the complete cDNA or gene sequence.

(b) As used herein, "comparison window" makes reference to a contiguous and specified segment of a polynucleotide sequence, wherein the polynucleotide sequence in the comparison window may comprise additions or deletions (i.e., gaps) compared to the reference sequence (which does not comprise additions or deletions) for optimal alignment of the two polynucleotides. Generally, the comparison window is at least 20 contiguous nucleotides in length, and optionally can be 30, 40, 50, 100, or longer. Those of skill in the art understand that to avoid a high similarity to a reference sequence due to inclusion of gaps in the polynucleotide sequence a gap penalty is typically introduced and is subtracted from the number of matches.

Methods of alignment of sequences for comparison are well known in the art. Thus, the determination of percent sequence identity between any two sequences can be accomplished using a mathematical algorithm. Non-limiting examples of such mathematical algorithms are the algorithm of Myers and Miller (1988) *CABIOS* 4:11-17; the local alignment algorithm of Smith et al. (1981) *Adv. Appl. Math.* 2:482; the global alignment algorithm of Needleman and Wunsch (1970) *J. Mol. Biol.* 48:443-453; the search-for-local alignment method of Pearson and Lipman (1988) *Proc. Natl. Acad. Sci.* 85:2444-2448; the algorithm of Karlin and Altschul (1990) *Proc. Natl. Acad. Sci. USA* 872264, modified as in Karlin and Altschul (1993) *Proc. Natl. Acad. Sci. USA* 90:5873-5877.

Computer implementations of these mathematical algorithms can be utilized for comparison of sequences to determine sequence identity. Such implementations include, but are not limited to: CLUSTAL in the PC/Gene program (available from Intelligenetics, Mountain View, Calif.); the ALIGN program (Version 2.0) and GAP, BESTFIT, BLAST, FASTA, and TFASTA in the GCG Wisconsin Genetics Software Package, Version 10 (available from Accelrys Inc., 9685 Scranton Road, San Diego, Calif., USA). Alignments using these programs can be performed using the default parameters. The CLUSTAL program is well described by Higgins et al. (1988) *Gene* 73:237-244 (1988); Higgins et al. (1989) *CABIOS* 5:151-153; Corpet et al. (1988) *Nucleic Acids Res.* 16:10881-90; Huang et al. (1992) *CABIOS* 8:155-65; and Pearson et al. (1994) *Meth. Mol. Biol.* 24:307-331. The ALIGN program is based on the algorithm of Myers and Miller (1988) supra. A PAM120 weight residue table, a gap length penalty of 12, and a gap penalty of 4 can be used with the ALIGN program when comparing amino acid sequences. The BLAST programs of Altschul et at (1990) *J. Mol. Biol.* 215:403 are based on the algorithm of Karlin and Altschul (1990) supra. BLAST nucleotide searches can be performed with the BLASTN program, score=100, wordlength=12, to obtain nucleotide sequences homologous to a nucleotide sequence encoding a protein of the invention. BLAST protein searches can be performed with the BLASTX program, score=50, wordlength=3, to obtain amino acid sequences homologous to a protein or polypeptide of the invention. To obtain gapped alignments for comparison purposes, Gapped BLAST (in BLAST 2.0) can be utilized as described in Altschul et al. (1997) *Nucleic Acids Res.* 25:3389. Alternatively, PSI-BLAST (in BLAST 2.0) can be used to perform an iterated search that detects distant relationships between molecules. See Altschul et al. (1997) supra. When utilizing BLAST, Gapped BLAST, PSI-BLAST, the default parameters of the respective programs (e.g., BLASTN for nucleotide sequences, BLASTX for proteins) can be used. See on the World Wide Web at ncbi.nlm.gov. Alignment may also be performed manually by inspection.

Unless otherwise stated, sequence identity/similarity values provided herein refer to the value obtained using GAP Version 10 using the following parameters: % identity and % similarity for a nucleotide sequence using GAP Weight of 50 and Length Weight of 3, and the nwsgapdna.cmp scoring matrix; % identity and % similarity for an amino acid sequence using GAP Weight of 8 and Length Weight of 2, and the BLOSUM62 scoring matrix. By "equivalent program" is intended any sequence comparison program that, for any two sequences in question, generates an alignment having identical nucleotide or amino acid residue matches and an identical percent sequence identity when compared to the corresponding alignment generated by GAP Version 10.

GAP uses the algorithm of Needleman and Wunsch (1970) *J. Mol. Biol.* 48:443-453, to find the alignment of two complete sequences that maximizes the number of matches and minimizes the number of gaps. GAP considers all possible alignments and gap positions and creates the alignment with the largest number of matched bases and the fewest gaps. It allows for the provision of a gap creation penalty and a gap extension penalty in units of matched bases. GAP must make a profit of gap creation penalty number of matches for each gap it inserts. If a gap extension penalty greater than zero is chosen, GAP must, in addition, make a profit for each gap inserted of the length of the gap times the gap extension penalty. Default gap creation penalty values and gap extension penalty values in Version 10 of the GCG Wisconsin Genetics Software Package for protein sequences are 8 and 2, respectively. For nucleotide sequences the default gap creation penalty is 50 while the default gap extension penalty is 3. The gap creation and gap extension penalties can be expressed as an integer selected from the group of integers consisting of from 0 to 200. Thus, for example, the gap creation and gap extension penalties can be 0, 1, 2, 3, 4, 5, 6, 7, 8, 9, 10, 15, 20, 25, 30, 35, 40, 45, 50, 55, 60, 65 or greater.

GAP presents one member of the family of best alignments. There may be many members of this family, but no other member has a better quality. GAP displays four figures of merit for alignments: Quality, Ratio, Identity, and Similarity. The Quality is the metric maximized in order to align the sequences. Ratio is the quality divided by the number of bases in the shorter segment. Percent Identity is the percent of the symbols that actually match. Percent Similarity is the percent of the symbols that are similar. Symbols that are across from gaps are ignored. A similarity is scored when the scoring matrix value for a pair of symbols is greater than or equal to 0.50, the similarity threshold. The scoring matrix used in Version 10 of the GCG Wisconsin Genetics Software Package is BLOSUM62 (see Henikoff and Henikoff (1989) *Proc. Natl. Acad. Sci. USA* 89:10915).

(c) As used herein, "sequence identity" or "identity" in the context of two polynucleotides or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity". Means for making this adjustment are well known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., as implemented in the program PC/GENE (Intelligenetics, Mountain View, Calif.).

(d) As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity.

(D) Expression Cassette

The use of the term "polynucleotide" is not intended to limit the present invention to polynucleotides comprising DNA. Those of ordinary skill in the art will recognize that polynucleotides, can comprise ribonucleotides and combinations of ribonucleotides and deoxyribonucleotides. Such deoxyribonucleotides and ribonucleotides include both naturally occurring molecules and synthetic analogues. The polynucleotides of the invention also encompass all forms of sequences including, but not limited to, single-stranded forms, double-stranded forms, hairpins, stem-and-loop structures, and the like.

Any high oil- or high oleic-acid associated polynucleotide sequences within the QTL6 region that confer the high oil and/or high oleic acid and/or increased oleic acid/linoleic acid ratio phenotypic trait, including the marker loci sequences set forth in SEQ ID NOs:1, 3, 5, 7, 9, 11, 13, 15, 17, 19, 21, 23, 25, 27, 29, 31, 33, 35, 37, 39, 41, 43, and 45, and the coding sequences set forth in SEQ ID NOs:47, 55, 57, 59, and 63, as well as variants and fragments thereof, can be included as part of an expression cassette. Thus, for example, the polynucleotides encoding the high oil/high oleic acid DGAT (i.e., ZmDGAT1-2(ASK), amino acid permease, PESP, ribosomal protein, or ABC transporter protein of the invention can be provided in expression cassettes for expression in the plant of interest. Alternatively, or in addition to one or more of these marker loci sequences, the polynucleotide encoding the normal oil DGAT of the invention (for example, SEQ ID NO:51 encoding ZmDGAT1-2(EF09B) of SEQ ID NO:52), as well as variants and fragments thereof, can be included in the same or a different expression cassette to provide for overexpression of the normal oil DGAT. In this manner, the cassette will include 5' and 3' regulatory sequences operably linked to a polynucleotide encoding the high oil/high oleic acid DGAT, the normal oil DGAT, amino acid permease, PESP, ribosomal protein, or ABC transporter protein of the invention polynucleotide of the invention. "Operably linked" is intended to mean a functional linkage between two or more elements. For example, an operable linkage between a polynucleotide of interest and a regulatory sequence (i.e., a promoter) is functional link that allows for expression of the polynucleotide of interest. Operably linked elements may be contiguous or non-contiguous. When used to refer to the joining of two protein coding regions, by operably linked is intended that the coding regions are in the same reading frame. The cassette may additionally contain at least one additional gene to be cotransformed into the organism. Alternatively, the additional gene(s) can be provided on multiple expression cassettes. Such an expression cassette is provided with a plurality of restriction sites and/or recombination sites for insertion of the polynucleotide of interest, for example, polynucleotides encoding the high oil/high oleic acid DGAT, normal oil DGAT, amino acid permease, PESP, ribosomal protein, or ABC transporter protein of the invention, to be under the transcriptional regulation of the regulatory regions. The expression cassette may additionally contain selectable marker genes.

The expression cassette will include in the 5'-3' direction of transcription, a transcriptional and translational initiation region (i.e., a promoter), a polynucleotide of the invention, for example, a polynucleotide encoding the high oil/high oleic acid DGAT, normal oil DGAT, amino acid permease, PESP, ribosomal protein, or ABC transporter protein of the invention, and a transcriptional and translational termination region (i.e., termination region) functional in plants. The regulatory regions (i.e., promoters, transcriptional regulatory regions, and translational termination regions) and/or the polynucleotide of the invention may be native/analogous to the host cell or to each other. Alternatively, the regulatory regions and/or the polynucleotide of the invention may be heterologous to the host cell or to each other. As used herein, "heterologous" in reference to a sequence is a sequence that originates from a foreign species, or, if from the same species, is substantially modified from its native form in composition and/or genomic locus by deliberate human intervention. For example, a promoter operably linked to a heterologous polynucleotide is from a species different from the species from which the polynucleotide was derived, or, if from the same/ analogous species, one or both are substantially modified from their original form and/or genomic locus, or the promoter is not the native promoter for the operably linked polynucleotide. As used herein, a chimeric gene comprises a coding sequence operably linked to a transcription initiation region that is heterologous to the coding sequence.

While it may be optimal to express the sequences using heterologous promoters, the native promoter sequences may be used. Such constructs can change expression levels of the high oil/high oleic acid DGAT, normal oil DGAT, amino acid permease, PESP, ribosomal protein, or ABC transporter protein of the invention in the plant or plant cell. Thus, the phenotype of the plant or plant cell can be altered.

In this manner, expression of a high oil/high oleic acid DGAT, for example, the ZmDGAT1-2(ASK) of SEQ ID NO:48, encoded, for example, by the ZmDGAT1-2(ASK) polynucleotide set forth in SEQ ID NO:47, can be driven by its native promoter sequence (complementary strand to ZmDGAT1-2(ASK) promoter is set forth in SEQ ID NO:130), or a promoter sequence for a related DGAT polypeptide, for example, the ZmDGAT1-2(Mo17) promoter sequence (complementary strand to ZmDGAT1-2(Mo17) promoter is set forth in SEQ ID NO:119), or biologically active variants thereof.

In like manner, expression of a normal oil DGAT, for example, the ZmDGAT1-2(Mo17) of SEQ ID NO:50, encoded, for example, by the ZmDGAT1-2(Mo17) polynucleotide set forth in SEQ ID NO:49, can be driven by its native promoter sequence (complementary strand to ZmDGAT1-2(Mo17) promoter is set forth in SEQ ID NO:119), or a promoter sequence for a related DGAT polypeptide, for example, the ZmDGAT1-2(ASK) promoter sequence (complementary strand to ZmDGAT1-2(ASK) promoter is set forth in SEQ ID NO:130), or biologically active variants thereof.

Similarly, expression of the ZmAAP1 of SEQ ID NO:56, encoded, for example, by the ZmAAP1 polynucleotide set forth in SEQ ID NO:55, can be driven by its native promoter sequence, set forth as nucleotides 6161-6888 of SEQ ID NO:117 (see also SEQ ID NO:120), or a biologically active variant thereof. Expression of the ZmPESP of SEQ ID NO:58, encoded, for example, by the ZmPESP polynucleotide set forth in SEQ ID NO:57, can be driven by its native promoter sequence, set forth as nucleotides 153888-156887 of SEQ ID NO:116 (see also SEQ ID NO:121) or a biologically active variant thereof (see, for example, the ZmPESP (ASK) promoter sequence set forth in SEQ ID NO:129). Expression of the ZmS24 of SEQ ID NO:60, encoded, for example, by the ZmS24 polynucleotide of SEQ ID NO:59, can be driven by its native promoter sequence, set forth as nucleotides 1824-4823 of SEQ ID NO:117 (see also SEQ ID NO:122), or a biologically active variant thereof. Expression of the ZmABCT of SEQ ID NO:64, encoded, for example, by the ZmABCT polynucleotide of SEQ ID NO:63, can be driven by its native promoter sequence, set forth as nucleotides 254826-257825 of SEQ ID NO:116 (see also SEQ ID NO:123), or a biologically active variant thereof.

The termination region may be native with the transcriptional initiation region, may be native with the operably linked polynucleotide of interest, may be native with the plant host, or may be derived from another source (i.e., foreign or heterologous) to the promoter, the polynucleotide of interest, the plant host, or any combination thereof. Convenient termination regions are available from the Ti-plasmid of *A. tumefaciens*, such as the octopine synthase and nopaline synthase termination regions. See also Guerineau et al. (1991) *Mol. Gen. Genet.* 262:141-144; Proudfoot (1991) *Cell* 64:671-674; Sanfacon et al. (1991) *Genes Dev.* 5:141-149; Mogen et al. (1990) *Plant Cell* 2:1261-1272; Munroe et al. (1990) *Gene* 91:151-158; Ballas et al. (1989) *Nucleic Acids Res.* 17:7891-7903; and Joshi et al. (1987) *Nucleic Acids Res.* 15:9627-9639.

Where appropriate, the polynucleotides may be optimized for increased expression in the transformed plant. That is, the polynucleotides can be synthesized using plant-preferred codons for improved expression. See, for example, Campbell and Gowri (1990) *Plant Physiol.* 92: 1-11 for a discussion of host-preferred codon usage. Methods are available in the art for synthesizing plant-preferred genes. See, for example, U.S. Pat. Nos. 5,380,831, and 5,436,391, and Murray et al. (1989) *Nucleic Acids Res.* 17:477-498, herein incorporated by reference.

Additional sequence modifications are known to enhance gene expression in a cellular host. These include elimination of sequences encoding spurious polyadenylation signals, exon-intron splice site signals, transposon-like repeats, and other such well-characterized sequences that may be deleterious to gene expression. The G-C content of the sequence may be adjusted to levels average for a given cellular host, as calculated by reference to known genes expressed in the host cell. When possible, the sequence is modified to avoid predicted hairpin secondary mRNA structures.

The expression cassettes may additionally contain 5' leader sequences. Such leader sequences can act to enhance translation. Translation leaders are known in the art and include: picornavirus leaders, for example, EMCV leader (Encephalomyocarditis 5' noncoding region) (Elroy-Stein et al. (1989) *Proc. Natl. Acad. Sci. USA* 86:6126-6130); potyvirus leaders, for example, TEV leader (Tobacco Etch Virus) (Gallie et al. (1995) *Gene* 165(2):233-238), MDMV leader (Maize Dwarf Mosaic Virus) (*Virology* 154:9-20), and human immunoglobulin heavy-chain binding protein (BiP) (Macejak et al. (1991) *Nature* 353:90-94); untranslated leader from the coat protein mRNA of alfalfa mosaic virus (AMV RNA 4) (Jobling et al. (1987) *Nature* 325:622-625); tobacco mosaic virus leader (TMV) (Gallie et al. (1989) in *Molecular Biology of RNA*, ed. Cech (Liss, New York), pp. 237-256); and maize chlorotic mottle virus leader (MCMV) (Lommel et al. (1991) *Virology* 81:382-385). See also, Della-Cioppa et al. (1987) *Plant Physiol.* 84:965-968.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

A number of promoters can be used in the practice of the invention, including the native promoter of the polynucleotide sequence of interest. The promoters can be selected based on the desired outcome. The nucleic acids can be combined with constitutive, tissue-preferred, or other promoters for expression in plants.

Such constitutive promoters include, for example, the core promoter of the Rsyn7 promoter and other constitutive promoters disclosed in WO 99/43838 and U.S. Pat. No. 6,072,050; the core CaMV 35S promoter (Odell et al. (1985) *Nature* 313:810-812); rice actin (McElroy et al. (1990) *Plant Cell* 2:163-171); ubiquitin (Christensen et al. (1989) *Plant Mol. Biol.* 12:619-632 and Christensen et al. (1992) *Plant Mol. Biol.* 18:675-689); pEMU (Last et al. (1991) *Theor. Appl. Genet.* 81:581-588); MAS (Velten et al. (1984) *EMBO J.* 3:2723-2730); ALS promoter (U.S. Pat. No. 5,659,026), and the like. Other constitutive promoters include, for example, U.S. Pat. Nos. 5,608,149; 5,608,144; 5,604,121; 5,569,597; 5,466,785; 5,399,680; 5,268,463; 5,608,142; and 6,177,611.

Chemical-regulated promoters can be used to modulate the expression of a gene in a plant through the application of an exogenous chemical regulator. Depending upon the objective, the promoter may be a chemical-inducible promoter, where application of the chemical induces gene expression, or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters (see, for example, the glucocorticoid-inducible promoter in Schena et al. (1991) *Proc. Natl. Acad. Sci. USA* 88:10421-10425 and McNellis et al. (1998) *Plant J.* 14(2):247-257) and tetracycline-inducible and tetracycline-repressible promoters (see, for example, Gatz et al. (1991) *Mol. Gen. Genet.* 227:229-237, and U.S. Pat. Nos. 5,814,618 and 5,789,156), herein incorporated by reference.

Tissue-preferred promoters can be utilized to target enhanced expression of the sequence of interest, for example, the high oil/high oleic acid DGAT, normal oil DGAT, amino acid permease, PESP, ribosomal protein, and/or ABC transporter protein of the invention, within a particular plant tissue. Tissue-preferred promoters include Yamamoto et al. (1997) *Plant J.* 12(2):255-265; Kawamata et al. (1997) *Plant Cell Physiol.* 38(7):792-803; Hansen et al. (1997) *Mol. Gen. Genet.* 254(3):337-343; Russell et al. (1997) *Transgenic Res.* 6(2):157-168; Rinehart et al. (1996) *Plant Physiol.* 112(3): 1331-1341; Van Camp et al. (1996) *Plant Physiol.* 112(2): 525-535; Canevascini et al. (1996) *Plant Physiol.* 112(2): 513-524; Yamamoto et al. (1994) *Plant Cell Physiol.* 35(5): 773-778; Lam (1994) *Results Probl. Cell Differ.* 20:181-196; Orozco et al. (1993) *Plant Mol. Biol.* 23(6):1129-1138; Matsuoka et al. (1993) *Proc Natl. Acad. Sci. USA* 90(20):9586-9590; and Guevara-Garcia et al. (1993) *Plant J.* 4(3):495-505. Such promoters can be modified, if necessary, for weak expression.

"Seed-preferred" promoters include both "seed-specific" promoters (those promoters active during seed development such as promoters of seed storage proteins) as well as "seed-germinating" promoters (those promoters active during seed germination). See Thompson et al. (1989) *BioEssays* 10:108, herein incorporated by reference. Such seed-preferred promoters include, but are not limited to, Cim1 (cytokinin-induced message); cZ19B1 (maize 19 kDa zein); milps (myo-inositol-1-phosphate synthase) (see WO 00/11177 and U.S. Pat. No. 6,225,529; herein incorporated by reference). Gamma-zein is an endosperm-specific promoter. Globulin 1 (Glb-1) is a representative embryo-specific promoter. For dicots, seed-specific promoters include, but are not limited to, bean β-phaseolin, napin, β-conglycinin, soybean lectin, cruciferin, and the like. For monocots, seed-specific promoters include, but are not limited to, maize 15 kDa zein, 22 kDa zein, 27 kDa zein, gamma-zein, waxy, shrunken 1, shrunken 2, Globulin 1, etc. See also WO 00/12733, where seed-preferred promoters from end1 and end2 genes are disclosed; herein incorporated by reference.

The expression cassette can also comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D). Additional selectable markers include phenotypic markers such as β-galactosidase and fluorescent proteins such as green fluorescent protein (GFP) (Su et al. (2004) *Biotechnol Bioeng* 85:610-9 and Fetter et al. (2004) *Plant Cell* 16:215-28), cyan florescent protein (CYP) (Bolte et al. (2004) *J. Cell Science* 117:943-54 and Kato et al. (2002) *Plant Physiol* 129:913-42), and yellow florescent protein (PhiYFP™ from Evrogen, see, Bolte et al. (2004) *J. Cell Science* 117:943-54). For additional selectable markers, see generally, Yarranton (1992) *Curr. Opin. Biotech.* 3:506-511; Christopherson et al. (1992) *Proc. Natl. Acad. Sci. USA* 89:6314-6318; Yao et al. (1992) *Cell* 71:63-72; Reznikoff (1992) *Mol. Microbiol.* 6:2419-2422; Barkley et al (1980) in *The Operon*, pp. 177-220; Hu et al (1987) *Cell* 48:555-566; Brown et al. (1987) *Cell* 49:603-612; Figge et al. (1988) *Cell* 52:713-722; Deuschle et al (1989) *Proc. Natl. Acad. Aci. USA* 86:5400-5404; Fuerst et al. (1989) *Proc. Natl. Acad. Sci. USA* 86:2549-2553; Deuschle et al. (1990) *Science* 248:480-483; Gossen (1993) Ph.D. Thesis, University of Heidelberg; Reines et al. (1993) *Proc. Natl. Acad. Sci. USA* 90:1917-1921; Labow et al. (1990) *Mol. Cell. Biol.* 10:3343-3356; Zambretti et al. (1992) *Proc. Natl. Acad. Sci. USA* 89:3952-3956; Baim et al. (1991) *Proc. Natl. Acad. Sci. USA* 88:5072-5076; Wyborski et al. (1991) *Nucleic Acids Res.* 19:4647-4653; Hillenand-Wissman (1989) *Topics Mol. Struc. Biol.* 10: 143-162; Degenkolb et al. (1991) *Antimicrob. Agents Chemother.* 35:1591-1595; Kleinschnidt et al. (1988) *Biochemistry* 27:1094-1104; Bonin (1993) Ph.D. Thesis, University of Heidelberg; Gossen et al. (1992) *Proc. Natl. Acad. Sci. USA* 89:5547-5551; Oliva et al. (1992) *Antimicrob. Agents Chemother.* 36:913-919; Hlavka et al. (1985) *Handbook of Experimental Pharmacology*, Vol. 78 (Springer-Verlag, Berlin); Gill et al. (1988) *Nature* 334:721-724. Such disclosures are herein incorporated by reference.

The above list of selectable marker genes is not meant to be limiting. Any selectable marker gene can be used in the present invention.

(E) Methods of Introducing the Recombinant Polynucleotide into a Plant or Part Thereof The methods of the invention involve introducing a polypeptide or polynucleotide into a plant. "Introducing" is intended to mean presenting to the plant the polynucleotide or polypeptide in such a manner that the sequence gains access to the interior of a cell of the plant. The methods of the invention do not depend on a particular method for introducing a sequence into a plant, only that the polynucleotide or polypeptides gains access to the interior of at least one cell of the plant. Methods for introducing polynucleotide or polypeptides into plants are known in the art including, but not limited to, stable transformation methods, transient transformation methods, and virus-mediated methods.

"Stable transformation" is intended to mean that the nucleotide construct introduced into a plant integrates into the genome of the plant and is capable of being inherited by the progeny thereof. "Transient transformation" is intended to mean that a polynucleotide is introduced into the plant and does not integrate into the genome of the plant or a polypeptide is introduced into a plant.

Transformation protocols as well as protocols for introducing polypeptides or polynucleotide sequences into plants may vary depending on the type of plant or plant cell, i.e., monocot or dicot, targeted for transformation. Suitable methods of introducing polypeptides and polynucleotides into plant cells include microinjection (Crossway et al. (1986) *Biotechniques* 4:320-334), electroporation (Riggs et al. (1986) *Proc. Natl. Acad. Sci. USA* 83:5602-5606, *Agrobacterium*-mediated transformation (U.S. Pat. No. 5,563,055 and U.S. Pat. No. 5,981,840), direct gene transfer (Paszkowski et al. (1984) *EMBO J.* 3:2717-2722), and ballistic particle acceleration (see, for example, U.S. Pat. No. 4,945,050; U.S. Pat. No. 5,879,918; U.S. Pat. Nos. 5,886,244; and, 5,932,782; Tomes et al. (1995) in *Plant Cell, Tissue, and Organ Culture: Fundamental Methods*, ed. Gamborg and Phillips (Springer-Verlag, Berlin); McCabe et al. (1988) *Biotechnology* 6:923-926); and Lec1 transformation (WO 00/28058). Also see Weissinger et al. (1988) *Ann. Rev. Genet.* 22:421-477; Sanford et al. (1987) *Particulate Science and Technology* 5:27-37 (onion); Christou et al. (1988) *Plant Physiol.* 87:671-674 (soybean); McCabe et al. (1988) *Bio/Technology* 6:923-926 (soybean); Finer and McMullen (1991) *In Vitro Cell Dev. Biol.* 27P:175-182 (soybean); Singh et al. (1998) *Theor. Appl. Genet.* 96:319-324 (soybean); Datta et al. (1990) *Biotechnology* 8:736-740 (rice); Klein et al. (1988) *Proc. Natl. Acad. Sci. USA* 85:4305-4309 (maize); Klein et al. (1988) *Biotechnology* 6:559-563 (maize); U.S. Pat. Nos. 5,240,855; 5,322,783; and, 5,324,646; Klein et al. (1988) *Plant Physiol.* 91:440-444 (maize); Fromm et al. (1990) *Biotechnology* 8:833-839 (maize); Hooykaas-Van Slogteren et al. (1984) *Nature (London)* 311:763-764; U.S. Pat. No. 5,736,369 (cereals); Bytebier et al. (1987) *Proc. Natl. Acad. Sci. USA* 84:5345-5349 (Liliaceae); De Wet et al. (1985) in *The Experimental Manipulation of Ovule Tissues*, ed. Chapman et al. (Longman, N.Y.), pp. 197-209 (pollen); Kaeppler et al. (1990) *Plant Cell Reports* 9:415-418 and Kaeppler et al. (1992) *Theor. Appl. Genet.* 84:560-566 (whisker-mediated transformation); D'Halluin et al. (1992) *Plant Cell* 4:1495-1505 (electroporation); Li et al. (1993) *Plant Cell Reports* 12:250-255 and Christou and Ford (1995) *Annals of Botany* 75:407-413 (rice); Osjoda et al. (1996) *Nature Biotechnology* 14:745-750 (maize via *Agrobacterium tumefaciens*); all of which are herein incorporated by reference.

In specific embodiments, one or more of the polynucleotides of the invention, for example, the marker loci sequences set forth in SEQ ID NOs:1, 3, 5, 7, 9, 11, 13, 15, 17, 19, 21, 23, 25, 27, 29, 31, 33, 35, 37, 39, 41, 43, and 45, and the coding sequences set forth in SEQ ID NOs:47, 51, 55, 57, 59, and 63, as well as variants and fragments thereof, can be provided to a plant using a variety of transient transformation methods. Such transient transformation methods include, but are not limited to, the introduction of the high oil/high oleic acid DGAT, normal oil DGAT, amino acid permease, PESP, ribosomal protein, or ABC transporter protein of the invention or variants and fragments thereof directly into the plant or the introduction into the plant of a polynucleotide encoding these respective proteins. Such methods include, for example, microinjection or particle bombardment. See, for example, Crossway et al. (1986) *Mol. Gen. Genet.* 202:179-185; Nomura et al. (1986) *Plant Sci.* 44:53-58; Hepler et al. (1994) *Proc. Natl. Acad. Sci.* 91: 2176-2180 and Hush et al. (1994) *The Journal of Cell Science* 107:775-784, all of which are herein incorporated by reference. Alternatively, the polynucleotide of interest, including the marker loci sequences set forth in SEQ ID NOs:1, 3, 5, 7, 9, 11, 13, 15, 17, 19, 21, 23, 25, 27, 29, 31, 33, 35, 37, 39, 41, 43, and 45, and the coding sequences set forth in SEQ ID NOs:47, 51, 55, 57, 59, and 63, as well as variants and fragments thereof, can be transiently transformed into the plant using techniques known in the art. Such techniques include viral vector system and the precipitation of the polynucleotide in a manner that precludes subsequent release of the DNA. Thus, the transcription from the particle-bound DNA can occur, but the frequency with which its released to become integrated into the genome is greatly reduced. Such methods include the use particles coated with polyethylimine (PEI; Sigma #P3143).

In other embodiments, the polynucleotide of the invention may be introduced into plants by contacting plants with a virus or viral nucleic acids. Generally, such methods involve incorporating a nucleotide construct of the invention within a viral DNA or RNA molecule. It is recognized that a polypeptide of the invention, for example, the high oil/high oleic acid DGAT, normal oil DGAT, amino acid permease, PESP, ribosomal protein, or ABC transporter protein of the invention of the invention may be initially synthesized as part of a viral polyprotein, which later may be processed by proteolysis in vivo or in vitro to produce the desired recombinant protein. Further, it is recognized that promoters of the invention also encompass promoters utilized for transcription by viral RNA polymerases. Methods for introducing polynucleotides into plants and expressing a protein encoded therein, involving viral DNA or RNA molecules, are known in the art. See, for example, U.S. Pat. Nos. 5,889,191, 5,889,190, 5,866,785, 5,589,367, 5,316,931, and Porta et al. (1996) *Molecular Biotechnology* 5:209-221; herein incorporated by reference.

Methods are known in the art for the targeted insertion of a polynucleotide at a specific location in the plant genome. In one embodiment, the insertion of the polynucleotide at a desired genomic location is achieved using a site-specific recombination system. See, for example, WO99/25821, WO99/25854, WO99/25840, WO99/25855, and WO99/25853, all of which are herein incorporated by reference. Briefly, the polynucleotide of the invention can be contained in transfer cassette flanked by two non-recombinogenic recombination sites. The transfer cassette is introduced into a plant having stably incorporated into its genome a target site which is flanked by two non-recombinogenic recombination sites that correspond to the sites of the transfer cassette. An appropriate recombinase is provided and the transfer cassette is integrated at the target site. The polynucleotide of interest is thereby integrated at a specific chromosomal position in the plant genome.

The cells that have been transformed may be grown into plants in accordance with conventional ways. See, for example, McCormick et al. (1986) *Plant Cell Reports* 5:81-84. These plants may then be grown, and either pollinated with the same transformed strain or different strains, and the resulting progeny having constitutive expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved. In this manner, the present invention provides transformed seed (also referred to as "transgenic seed") having a polynucleotide of the invention, for example, an expression cassette of the invention, stably incorporated into their genome.

(F) Plants and Parts Thereof

Compositions of the invention further include plants, plant parts, and plant cells having one or more of the recombinant polynucleotides of the invention. In specific embodiments, the recombinant polynucleotide(s) is (are) stably integrated into the genome of the plant, plant part or plant cell.

As used herein, the term plant includes plant cells, plant protoplasts, plant cell tissue cultures from which plants can be regenerated, plant calli, plant clumps, and plant cells that are intact in plants or parts of plants such as embryos (germ), pollen, ovules, seeds, leaves, flowers, branches, fruit, kernels, ears, cobs, husks, stalks, roots, root tips, anthers, and the like. Grain is intended to mean the mature seed produced by commercial growers for purposes other than growing or reproducing the species. Progeny, variants, and mutants of the regenerated plants are also included within the scope of the invention, provided that these parts comprise the introduced polynucleotides.

The present invention may be used for transformation of any plant species, including, but not limited to, monocots and dicots. Examples of plant species of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassaya (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables, ornamentals, and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum.

Conifers that may be employed in practicing the present invention include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas-fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). In specific embodiments, plants of the present invention are crop plants (for example, corn, alfalfa, sunflower, *Brassica*, soybean, cotton, safflower, peanut, sorghum, wheat, millet, tobacco, etc.). In other embodiments, corn and soybean plants are optimal, and in yet other embodiments corn plants are optimal.

Other plants of interest include grain plants that provide seeds of interest, oil-seed plants, and leguminous plants. Seeds of interest include grain seeds, such as corn, wheat, barley, rice, sorghum, rye, etc. Oil-seed plants include cotton, soybean, safflower, sunflower, *Brassica*, maize, alfalfa, palm, coconut, etc. Leguminous plants include beans and peas. Beans include guar, locust bean, fenugreek, soybean, garden beans, cowpea, mungbean, lima bean, fava bean, lentils, chickpea, etc.

In some embodiments, the plants of the invention comprise a heterologous polynucleotide that is genetically linked to the QTL6 region identified herein and which confers the high oil and/or high oleic acid and/or increased oleic acid/linoleic acid ratio phenotypic trait to a plant or plant part thereof. In this manner, plants of the invention can comprise stably incorporated into their genome a heterologous polynucleotide comprising at least one high oil-associated sequence or at least one high oleic acid-associated sequence operably linked to a promoter active in the plant or plant part, wherein the high oil-associated sequence or the high oleic acid-associated sequence is derived from a genomic nucleotide sequence genetically linked to at least one favorable marker locus that is associated with high oil or high oleic acid content, wherein the marker locus is selected from the group consisting of SEQ ID NO:2, 4, 6, 8, 10, 12, 14, 16, 18, 20, 22, 24, 26, 28, 30, 32, 34, 36, 38, 40, 42, 44, 46, and 51 with at least one polymorphism therein. Expression of the heterologous polynucleotide comprising the high oil-associated sequence or the high oleic acid-associated sequence increases the oil content or the oleic acid content in the plant or plant part. In some embodiments, the heterologous polynucleotide comprises at least one sequence selected from the group consisting of the sequences set forth in SEQ ID NOs:1, 3, 5, 7, 9, 11, 13, 15, 17, 19, 21, 23, 25, 27, 29, 31, 33, 35, 37, 39, 41, 43, 45, and 47, or a variant or fragment thereof comprising at least one of the polymorphisms identified in these respective sequences, wherein expression of the heterologous polynucleotide increases the oil content and/or the oleic acid content in the plant or plant part.

In other embodiments, the plants comprise an expression construct comprising a polynucleotide encoding the normal oil DGAT polypeptide of the invention (for example, ZmDGAT12-2(EF09B), or a biologically active variant or fragment thereof, operably linked to a promoter that is functional in a plant cell. This expression construct provides for overexpression of the normal oil DGAT polypeptide, or a biologically active fragment or variant thereof. As normal oil DGAT is involved in oil biosynthesis, overexpression o of this protein, or overexpression of a biologically active variant or fragment thereof, within a plant or plant part can lead to an increase in the oil content, oleic acid content, and/or oleic acid/linoleic acid ratio within that plant or plant part. See, for example, the methods described in Example 11 herein below.

In certain embodiments the polynucleotides of the present invention can be stacked with any combination of polynucleotide sequences of interest in order to create plants with a desired trait. A trait, as used herein, refers to the phenotype derived from a particular sequence or groups of sequences. For example, one or more of the polynucleotides of the present invention, which confer the high oil and/or high oleic acid phenotype, may be stacked with any other polynucleotides encoding polypeptides having pesticidal and/or insecticidal activity, such as other *Bacillus thuringiensis* toxic proteins (described in U.S. Pat. Nos. 5,366,892; 5,747,450; 5,737,514; 5,723,756; 5,593,881; and Geiser et al. (1986) *Gene* 48:109), lectins (Van Damme et al. (1994) *Plant Mol. Biol.* 24:825, pentin (described in U.S. Pat. No. 5,981,722), and the like. The combinations generated can also include multiple copies of any one of the polynucleotides of interest. The polynucleotides of the present invention can also be stacked with any other gene or combination of genes to produce plants with a variety of desired trait combinations including, but not limited to, traits desirable for animal feed such as high oil genes (e.g., U.S. Pat. No. 6,232,529) or genes that are involved in oil biosynthesis, including the normal oil DGAT disclosed herein (for example, ZmDGAT1-2(EF09B); balanced amino acids (e.g., hordothionins (U.S. Pat. Nos. 5,990,389; 5,885,801; 5,885,802; and 5,703,409); barley high lysine (Williamson et al. (1987) *Eur. J. Biochem.* 165: 99-106; and WO 98/20122) and high methionine proteins (Pedersen et al. (1986) *J. Biol. Chem.* 261:6279; Kirihara et al. (1988) *Gene* 71:359; and Musumura et al. (1989) *Plant Mol. Biol.* 12:123)); increased digestibility (e.g., modified storage proteins (U.S. application Ser. No. 10/053,410, filed Nov. 7, 2001); and thioredoxins (U.S. application Ser. No. 10/005,429, filed Dec. 3, 2001)); the disclosures of which are herein incorporated by reference.

The polynucleotides of the present invention can also be stacked with traits desirable for disease or herbicide resistance (e.g., fumonisin detoxification genes (U.S. Pat. No. 5,792,931); avirulence and disease resistance genes (Jones et al. (1994) *Science* 266:789; Martin et al. (1993) *Science* 262: 1432; Mindrinos et al. (1994) *Cell* 78:1089); acetolactate synthase (ALS) mutants that lead to herbicide resistance such as the S4 and/or Hra mutations; inhibitors of glutamine synthase such as phosphinothricin or basta (e.g., bar gene); and glyphosate resistance (EPSPS gene)); and traits desirable for processing or process products such as high oil (e.g., U.S. Pat. No. 6,232,529); modified oils (e.g., fatty acid desaturase genes (U.S. Pat. No. 5,952,544; WO 94/11516)); modified starches (e.g., ADPG pyrophosphorylases (AGPase), starch synthases (SS), starch branching enzymes (SBE), and starch debranching enzymes (SDBE)); and polymers or bioplastics (e.g., U.S. Pat. No. 5,602,321; beta-ketothiolase, polyhydroxybutyrate synthase, and acetoacetyl-CoA reductase (Schubert et al. (1988) *J. Bacteriol.* 170:5837-5847) facilitate expression of polyhydroxyalkanoates (PHAs)); the disclosures of which are herein incorporated by reference. One could also combine the polynucleotides of the present invention with polynucleotides providing agronomic traits such as male sterility (e.g., see U.S. Pat. No. 5,583,210), stalk strength, flowering time, or transformation technology traits such as cell cycle regulation or gene targeting (e.g., WO 99/61619, WO 00/17364, and WO 99/25821); the disclosures of which are herein incorporated by reference.

These stacked combinations can be created by any method including, but not limited to, cross-breeding plants by any conventional or TopCross methodology, or genetic transformation. If the sequences are stacked by genetically transforming the plants, the polynucleotide sequences of interest can be combined at any time and in any order. For example, a transgenic plant comprising one or more desired traits can be used as the target to introduce further traits by subsequent transformation. The traits can be introduced simultaneously in a co-transformation protocol with the polynucleotides of interest provided by any combination of transformation cassettes. For example, if two sequences will be introduced, the two sequences can be contained in separate transformation cassettes (trans) or contained on the same transformation cassette (cis). Expression of the sequences can be driven by the same promoter or by different promoters. In certain cases, it may be desirable to introduce a transformation cassette that will suppress the expression of another polynucleotide of interest. This may be combined with any combination of other suppression cassettes or overexpression cassettes to generate the desired combination of traits in the plant. It is further recognized that polynucleotide sequences can be stacked at a desired genomic location using a site-specific recombination system. See, for example, WO99/25821, WO99/25854, WO99/25840, WO99/25855, and WO99/25853, all of which are herein incorporated by reference.

In one such embodiment, one or more of the high oil- and/or high oleic acid-associated polynucleotides of the invention (for example, ZmDGAT1-2(ASK) of SEQ ID NO:47), or a normal oil DGAT polynucleotide of the invention (for example, ZmDGAT1-2(EF09B) of SEQ ID NO:51), or any combination thereof, is stacked with a heterologous polynucleotide encoding a Leafy Cotyledon 1 transcriptional activator (LEC1)-type B-domain or a biologically active variant or fragment thereof, which provides for the additional modulation of the level of oil in a plant. The Leafy Cotyledon 1 transcriptional activator (LEC1) is a member of the HAP (heme-activated protein)3 transcription activator family whose members are characterized as having three regions: the A, B, and C domains. The central B domain is conserved among family members and comprises the conserved DNA binding CCAAT-box binding motif. FIG. 33 provides a sequence alignment of various members of the HAP3 transcriptional activator family and denotes the positions of domain A, B, and C and further shows the conserved CCAAT-box. Based on both sequence identity and function, members of the HAP3 family have been divided into two classes: members having a LEC1-type B domain and members having a non-LEC1-type B domain. Overexpression of a polypeptide comprising a LEC1-type B domain in a plant or plant part thereof beneficially increases oil production in a plant or plant part thereof. See, for example, U.S. Patent Application Publication No. 20050160494, herein incorporated by reference in its entirety.

The B domains from various members of the HAP3 transcriptional activator family are aligned in FIG. 34. The B-domain for the *Arabidopsis* LEC1, from amino acid residue 28 to residue 117, shares between 55% and 63% identity (75-85% similarity) to other members of the HAP3 family, including maize (HAP3), chicken, lamprey, *Xenopus*, human, mouse, *Emericella nidulens, Schizosaccharomyces pombe, Saccharomyces cerevisiae* and *Kluuyveromyces lactis* (Lotan et al. (1998) *Cell* 93: 1193-1205). The top, lightly shaded sequences are representative members of the LEC1-type B domain, while the bottom, darkly shaded sequences are representative of members of the non-LEC1-type B domain.

Generally, the LEC1-type B domain comprises 16 conserved residues that differ from residues conserved at equivalent positions within non-LEC1-type B domains (Lee et al. (2003) *Proc. Natl. Acad. Sci. USA* 100:2152-2156, herein incorporated by reference in its entirety). These residues reside within a motif of the LEC1-type B domain that is represented by the consensus sequence set forth in SEQ ID NO:49. It is recognized, however, that the 16 conserved residues set forth in the consensus sequence for this motif of a LEC1-type B domain can be altered and the LEC1 polypeptide still retains LEC1 activity. See, for example, Lee et al. (2003) *Proc. Natl. Acad. Sci. USA* 100:2152-2156, herein incorporated by reference in its entirety, which demonstrates specific alterations in some of the conserved residues continues to allow the polypeptide to retain LEC1 activity. Amino acid D28 of SEQ ID NO:49 was found to play an important role in retaining LEC1 activity. In one embodiment, a LEC1-type B domain comprises the LEC-1 type B domain set forth in residues 36-126 of SEQ ID NO:51, which sets forth the maize LEC1 polypeptide. The LEC-1 type B domain of the maize LEC1 polypeptide is encoded by nucleotides 106-378 of SEQ ID NO:50, which sets forth the coding sequence for the maize LEC1 polypeptide. Various polynucleotides and polypeptides having LEC1-type B-domains are set forth in U.S. Patent Application Publication Nos. 20030126638 and 20030204870, both of which are herein incorporated by reference in their entirety.

As outlined in detail elsewhere herein, biologically active variants and fragments of the LEC1-type B domain can also be employed in the methods of the invention directed to the stacking of one or more of the high oil/high oleic acid-associated polynucleotides of the present invention, a normal oil DGAT polynucleotide of the invention, or any combination thereof, with a heterologous polynucleotide encoding a LEC1-type B domain, thereby conferring a high oil and/or high oleic acid and/or increased oleic acid/linoleic acid ratio phenotype on a plant or plant part thereof. Such variants and fragments are known in the art. See, for example, FIG. 34 and also Lee et al. (2003) *PNAS* 2152-2156 and U.S. Patent Application Publication No. 20050034193.

Biologically active fragments and variants of a LEC1-type B domain will continue to retain LEC1 activity when the domain is placed within the context of a functional A and/or a functional C domain of a HAP3 transcriptional activator. As used herein, "LEC1 activity" is defined as the ability of a polypeptide to enhance lipid synthesis as reflected in increased oil production.

In one embodiment, the LEC1 polynucleotide or polypeptide employed in the invention comprises the polynucleotide and polypeptide set forth in SEQ ID NO:50 and SEQ ID NO:51, respectively. As outlined in detail elsewhere herein, biologically active variants and fragments of the LEC1 polynucleotide and polypeptides can also be employed in the methods of the invention. Such variants and fragments are known in the art. See, for example, FIGS. 33 and 34 and also Lee et al. (2003) *PNAS* 2152-2156; Kwong et al. (2003) *The Plant Cell* 15:5-18; U.S. Patent Application Publication No. 20030126638; WO 02/57439, U.S. Pat. No. 6,825,397; U.S. Pat. No. 6,781,035; U.S. Patent Application Publication No. 20050034193; and WO 98/37184, each of which is herein incorporated by reference.

As used herein, a "HAP3 transcriptional activator" comprises a member of the HAP3 family. This family of transcriptional activators is structurally well characterized. See, Li et al. (1992) *Nucleic Acid Research* 20:1087-1091; Xing et al. (1993) *EMBO J.* 12:4647-4655; Kim et al. (1996) *Mol. Cell. Biol.* 16:4003-4013; Sinha et al. (1996) *Mol Cell Biol* 16:328-337; and, Lotan et al. (1998) *Cell* 93:1195-1205, each of which is herein incorporated by reference. In the methods and compositions of the invention, the HAP3 transcriptional activator comprises a LEC1-type B domain. Accordingly, a HAP3 transcriptional activator employed in the present invention can comprise a chimeric polypeptide having a functional A and/or a functional B domain from HAP3 transcriptional activator which in their native form may or may not have a LEC1-type B domain. See, for example, Lee et al. (2003) *PNAS* 2152-2156.

In one embodiment, a heterologous polynucleotide encoding a high oil/high oleic acid variant of DGAT, for example, the ZmDAGT1-2(ASK) polypeptide or biologically active variant or fragment thereof conferring the high oil/high oleic acid phenotype is stacked with a heterologous polynucleotide encoding a polypeptide comprising a LEC1-type B-domain having an amino acid sequence set forth in SEQ ID NO:65 or a biologically active variant or a fragment of SEQ ID NO:65, wherein the biologically active variant comprises at least 80% sequence identity to SEQ ID NO:65, wherein the polypeptide or the biologically active variant or fragment thereof has LEC1 activity. In some embodiments, the heterologous polynucleotide encoding the high oil/high oleic acid variant of DGAT comprises the polynucleotide sequence set forth in SEQ ID NO:47 or variant or fragment thereof and the polynucleotide encoding the LEC1-type B-domain comprises the polynucleotide sequence set forth in SEQ ID NO:66 or a variant or fragment thereof.

In yet other embodiments, a heterologous polynucleotide encoding a normal oil DGAT, for example, the ZmDGAT1-2 (EF09B) polypeptide, or biologically active variant or fragment thereof capable of increasing oil content and/or oleic acid content when overexpressed in a plant or plant part thereof, is stacked with a heterologous polynucleotide encoding a polypeptide comprising a LEC1-type B-domain having an amino acid sequence set forth in SEQ ID NO:65 or a biologically active variant or a fragment of SEQ ID NO:65, wherein the biologically active variant comprises at least 80% sequence identity to SEQ ID NO:65, wherein the polypeptide or the biologically active variant or fragment thereof has LEC1 activity. In some embodiments, the heterologous polynucleotide encoding the normal oil DGAT comprises the polynucleotide sequence set forth in SEQ ID NO:51 or variant or fragment thereof and the polynucleotide encoding the LEC1-type B-domain comprises the polynucleotide sequence set forth in SEQ ID NO:66 or a variant or fragment thereof.

It is recognized that where one or more polynucleotides of the invention is stacked with a heterologous polynucleotide encoding a polypeptide comprising a LEC1-type B-domain, these sequences can also be stacked with one or more polynucleotides that provide for inhibition of expression or function of a gene product that is involved in starch biosynthesis, thereby further enhancing oil production and alterations in the quality of the oil. In this manner, a decrease in starch synthesis can be achieved through reduced expression of genes that encode proteins that normally serve as starch nucleating proteins, enzymatic catalysts, or assimilate transporters involved in starch biosynthesis. Any of the mechanisms known in the art to effect inhibition of gene expression can be used to optimally interfere with starch biosynthesis genes including, but not limited to, genes encoding sucrose synthase, hexokinase(s), phosphoglucomutase, phosphoglucoisomerase, ADP-glucose pyrophosphorylase (AGP), amylogenin (a protein primer of starch biogenesis), soluble and bound starch synthase and starch branching enzymes, starch debranching enzymes, isoamylase enzymes, starch phosphorylases, and the Brittle-1 transport protein. See, for example, U.S. Patent Application Publication No. 20050160494, entitled "*Alteration of Oil Traits in Plants*," herein incorporated by reference in its entirety.

In other embodiments, one or more of the high oil- and/or high oleic acid-associated polynucleotides of the invention, or a normal oil DGAT polynucleotide of the invention (for example, ZmDGAT1-2(EF09B) of SEQ ID NO:51), or any combination thereof, is stacked with a heterologous polynucleotide that provides for alteration of the quality of the increased oil produced within the plant by altering expression or function of proteins or enzymes that are involved in lipid modification. Examples of proteins and enzymes that modify the characteristics of oil within a plant include, but are not limited to, any of the fatty acid desaturases, for example, stearoyl-acyl-carrier-protein desaturase (Fad1; see U.S. Pat. No. 6,117,677), delta-15 desaturase (omega-3) (Fad3; Shah et al. (1997) *Plant Physiol.* 114:1533-1539), delta-4 (trans) desaturase (Fad4; Xiao et al. (2001) *J. Biol. Chem.* 276: 31561-31566), delta-7 desaturase, (Fad5; see U.S. Pat. No. 6,635,451), omega-6 fatty-acid desaturase (Fad6; see U.S. Pat. No. 6,635,451), omega-3 fatty-acid desaturase (Fad7; Iba et al. (1993) *J. Biol. Chem.* 268:24099-24105), delta-5 desaturase (see U.S. Pat. No. 6,589,767), delta-9-desaturase (see U.S. Pat. No. 5,723,595), fatty acyl-CoA:fatty alcohol acyltransferase (wax synthase; see U.S. Pat. No. 6,492,509), beta-ketoacyl-ACP synthase in an antisense or sense orientation (see U.S. Pat. No. 6,483,008), and delta-12 fatty acid desaturase (FAD2), an enzyme that converts oleic acid to linoleic acid by introducing a double bond at the delta-12 position (Okuley et al. (1994) *Plant Cell* 6:147-58).

Examples of FAD2 and corresponding coding sequences are well known in the art. See for example GenBank Accession No. NM_112047; GenBank Accession No. AF243045; European Patent No. EP0668919 B1; U.S. Pat. No. 6,291, 742; U.S. Pat. No. 6,310,194; U.S. Pat. No. 6,323,392; U.S. Pat. No. 6,372,965; U.S. Patent Application Publication No. 20030033633; and U.S. Patent Application Publication No. 20030140372; all of which are incorporated in their entirety herein by reference. FAD2 proteins in corn have been identified. One such FAD2 protein is termed ZmFAD2-1 (nucleotide sequence set forth in SEQ ID NO:131, amino acid sequence set forth in SEQ ID NO:132) and the other is termed ZmFAD2-2 (Kinney et al. (2001) *Biochem. Soc. Trans.* 30:1099-1103; and Mikkilineni et al. (2003) *Theor. Appl. Genet.* 106:1326-1332). Suppression or deletion of both genes increases relative oleic acid concentration by 75%.

Thus, by interfering with fatty acid desaturase activity, for example, by inhibiting the expression or function of FAD2, the conversion of oleic acid into linoleic acid can be prevented, and thus, oleic acid accumulates in the plant or plant part thereof such as seed, including seed embryos.

In some embodiments, one or more of the high oil- and/or high oleic acid-associated polynucleotides of the invention, or a normal oil DGAT polynucleotide of the invention (for example, ZmDGAT1-2(EF09B) of SEQ ID NO:51), or any combination thereof, is stacked within a plant germplasm background that has a favorable allele for FAD2 that normally confers a high oleic acid phenotype to that plant. By "high oleic acid phenotype" in the context of a favorable allele for FAD2 is intended the plant or plant part thereof, for example, the seed or embryo, has an oleic acid concentration of about 30% or greater. Thus, for example, in maize, conventional lines that do not have a favorable FAD2 allele have an oleic acid concentration in seed or embryo of about 25% or less. See, for example, the oleic acid concentration in embryo of the normal oil maize indbred line, EF09B, in FIG. 4. Such stacking can be accomplished by introducing the high oil-and/or high oleic acid associated polynucleotides of the invention (for example, ZmDGAT1-2(ASK) of SEQ ID NO:47), or the normal oil DGAT polynucleotide of the invention (for example, ZmDGAT1-2(EF09B) of SEQ ID NO:51), or any combination thereof, into this favorable germplasm background, either via transformation methods or through breeding methods known in the art and described elsewhere herein. See, for example, the methods described in Example 14 herein below.

In other embodiments, one or more of the high oil- and/or high oleic acid-associated polynucleotides of the invention (for example, ZmDGAT1-2(ASK) of SEQ ID NO:47), or a normal oil DGAT polynucleotide of the invention (for example, ZmDGAT1-2(EF09B) of SEQ ID NO:51), or any combination thereof, is stacked with a heterologous polynucleotide that comprises an FAD2 inhibitory sequence designed to silence expression of an FAD2. Methods for silencing expression of FAD2 are disclosed in U.S. Patent Application Publication No. 20050160494 and WO 2005/063988, herein incorporated by reference in their entirety. By suppressing expression or function of an FAD2, further increases in the oleic acid content and/or the oleic acid/linoleic acid ratio can be achieved beyond that conferred by expression of the high oil- and/or high oleic acid-associated polynucleotides of the invention, or overexpression of the normal oil DGAT polynucleotide of the invention.

An "FAD2 inhibitory sequence" would refer to an inhibitory sequence that is capable of inhibiting the expression of an FAD2 (for example, an FAD2 inhibitory sequence targeting ZmFAD2-1), at the level of transcription and/or translation, or which is capable of inhibiting the function of an FAD2. When the phrase "capable of inhibiting" is used in the context of a polynucleotide inhibitory sequence, it is intended to mean that the inhibitory sequence itself exerts the inhibitory effect; or, where the inhibitory sequence encodes an inhibitory nucleotide molecule (for example, hairpin RNA, miRNA, or double-stranded RNA polynucleotides), or encodes an inhibitory polypeptide (i.e., a polypeptide that inhibits expression or function of the target gene product), following its transcription (for example, in the case of an inhibitory sequence encoding a hairpin RNA, miRNA, or double-stranded RNA polynucleotide) or its transcription and translation (in the case of an inhibitory sequence encoding an inhibitory polypeptide), the transcribed or translated product, respectively, exerts the inhibitory effect on the target gene product (i.e., inhibits expression or function of the target gene product).

Any nucleotide sequence encoding an FAD2 known in the art can be used in the methods of the invention that use a transgenic approach to stack the high oil- and/or high oleic acid-associated polynucleotides of the invention, or the normal oil DGAT1-2 of the invention, or any combination thereof, with a heterologous polynucleotide that is designed to inhibit expression or function of an FAD2. In some embodiments, the heterologous polynucleotide comprises an FAD2 nucleotide sequence, such as ZmFAD2-1 (SEQ ID NO:131), a nucleotide sequence encoding ZmFAD2-1 of SEQ ID NO:132, a ZmFAD2-2 nucleotide sequence, combinations of both, and the like. See, for example, the sequences disclosed in Mikkilineni et al. (2003) Theor. Appl. Genet. 106:1326-1332. In some embodiments, the FAD2 sequence is selected from, but not limited to, those disclosed in GenBank Accession No. NM_112047, GenBank Accession No. AF243045, U.S. Pat. No. 6,323,392, U.S. Pat. No. 6,372,965, U.S. Patent Application Publication No. 20030033633, and U.S. Patent Application Publication No. 20030140372, all of which are incorporated herein in their entirety by reference. In other embodiments, the heterologous polynucleotide comprises truncated regions of the ZmFAD2 nucleotide sequence, for example, ZmFAD2-1 of SEQ ID NO:131, in the sense orientation and antisense orientation; see, for example, SEQ ID NO:133.

For example, in some embodiments, the heterologous polynucleotide comprises an FAD2 inhibitory sequence that is expressed in the sense orientation. In some embodiments, the sense-oriented transcripts cause cosuppression. In other embodiments, the sense-orientated expression of truncated FAD2 transcripts cause nonfunctional proteins to be expressed and thus inhibit FAD2 activity. Alternatively, the FAD2 inhibitory sequence or sequences can be expressed in the antisense orientation and thus inhibit endogenous FAD2 expression or activity by antisense mechanisms.

In yet other embodiments, the FAD2 inhibitory sequence or sequences within the heterologous polynucleotide are expressed as a hairpin RNA, which has both a sense sequence and an antisense sequence component. In embodiments comprising a hairpin structure, the loop structure may comprise any suitable nucleotide sequence including for example 5' untranslated regions of the gene to be suppressed, such as the 5' UTR of FAD2, intron nucleotide sequences of alcohol dehydrogenase (adh1), random nucleotides, polynucleotide spacers, and the like (see also Bailey-Serres and Dawe (1996) Plant Physiol. 112:685). In some embodiments, the FAD2 inhibitory sequence or sequences expressed as a hairpin are encoded by an inverted region of FAD2-encoding nucleotide sequences such as the ZmFAD2-1 nucleotide sequence (SEQ ID NO:131), the ZmFAD2-2 nucleotide sequence, or a combination thereof. In yet other embodiments, the inhibitory sequences are expressed as double-stranded RNA where one inhibitory FAD2 sequence is expressed in the sense orientation and another complementary sequence is expressed in the antisense orientation. See, for example, the FAD2 inhibitory polynucleotide sequence set forth in SEQ ID NO:133. Double-stranded RNA, hairpin structures, and combinations thereof comprising FAD2 sequences may operate by RNA interference, cosuppression, antisense mechanism, any combination thereof, or by means of any other mechanism that causes inhibition of FAD2 expression or function.

In other embodiments, one or more of the high oil- and/or high oleic acid-associated polynucleotides of the invention is stacked with a heterologous polynucleotide encoding a polypeptide involved in alteration of oil traits in plants, where the polypeptide is one disclosed in U.S. Patent Application Publication No. 20030204870, entitled "Alteration of Oil Traits in Plants," herein incorporated by reference in its entirety. In one such embodiment, the polynucleotide encodes a CKC type 2 aintegumenta (SEQ ID NO:320 of U.S. Patent Application Publication No. 20030204870, coding sequence SEQ ID NO:319 of this patent application publication), which provides for the additional modulation of the level of oil in a plant.

In other embodiments of the invention, one or more of the high oil- and/or high oleic acid-associated polynucleotides of the invention is stacked with a "TUSC27" genetic background. Plants comprising the TUSC27 genetic background comprise a heritable TUSC Mu insertion allele into the 27 kD gamma-zein gene that contributes to improved grain quality, particularly improved digestability of the grain. See for example, U.S. Patent Application Publication No. 20050204418, entitled "Grain Quality through Altered Expression of Seed Proteins," herein incorporated by reference in its entirety.

III. Methods (A) Modulating the Level of a Sequence of the Invention

The introduction and expression of one or more of the high oil- and/or high oleic acid-associated polynucleotides of the invention, or a normal oil DGAT polynucleotide of the invention, in a plant allows for an increase in the level of the respective polynucleotide sequence of interest, and where the sequence comprises coding sequence, allows for an increase in the level of the encoded polypeptide, for example, a high oil/high oleic acid DGAT variant, a normal oil DGAT, an AAP1, a PESP, a 40S ribosomal S24 protein, and/or an ABC transporter protein. A "modulated level" or "modulating the level" of a polynucleotide or a polypeptide in the context of the methods of the present invention refers to any increase in the expression, concentration, and/or activity of a gene product (i.e., polypeptide or polynucleotide), including any relative increment in expression, concentration and/or activity. The term "expression" as used herein in the context of a gene product, refers to the biosynthesis of that product including the transcription or translation of the gene product. In general, the level of the polypeptide or the polynucleotide is increased by at least 1%, 5%, 10%, 20%, 30%, 40%, 50%, 60%, 70%, 80%, 90%, 120%, or greater relative to a native control plant, plant part, or cell. Modulation in the present invention may occur during and/or subsequent to growth of the plant to the desired stage of development. In specific embodiments, the polynucleotides or the polypeptides of the present invention are modulated in monocots, particularly maize.

The expression level of a high oil/high oleic acid DGAT variant, a normal oil DGAT, an AAP1, a PESP, a 40S ribosomal S24 protein, and/or an ABC transporter protein of the invention polypeptide may be measured directly, for example, by assaying for the level of the respective polypeptide in the plant, or indirectly, for example, by measuring the activity of the respective polypeptide in the plant. Methods for determining whether expression of a high oil/high oleic acid DGAT variant, an AAP1, a PESP, a 40S ribosomal S24 protein, and/or an ABC transporter protein, or biologically active variant or fragment thereof, confers the high oil and/or high oleic acid and/or increased oleic acid/linoleic acid phenotype on a plant or plant part thereof are known in the art and are described elsewhere herein. Similarly, methods for determining whether overexpression of a normal oil DGAT of the invention, or biologically active variant or fragment thereof, are also known in the art and are described elsewhere herein.

In specific embodiments, the polypeptide or the polynucleotide of the invention is introduced into the plant cell. Subsequently, a plant cell having the introduced sequence of the invention is selected using methods known to those of skill in the art such as, but not limited to, Southern blot analysis, DNA sequencing, PCR analysis, or phenotypic analysis. A plant or plant part altered or modified by the foregoing embodiments is grown under plant forming conditions for a time sufficient to modulate the concentration and/or activity of polypeptides of the present invention in the plant. Plant forming conditions are well known in the art and discussed briefly elsewhere herein.

It is also recognized that the level and/or activity of the polypeptide may be modulated by employing a polynucleotide that is not capable of directing, in a transformed plant, the expression of a protein or an RNA. For example, the polynucleotides of the invention may be used to design polynucleotide constructs that can be employed in methods for altering or mutating a genomic nucleotide sequence in an organism. Such polynucleotide constructs include, but are not limited to, RNA:DNA vectors, RNA:DNA mutational vectors, RNA:DNA repair vectors, mixed-duplex oligonucleotides, self-complementary RNA:DNA oligonucleotides, and recombinogenic oligonucleobases. Such nucleotide constructs and methods of use are known in the art. See, U.S. Pat. Nos. 5,565,350; 5,731,181; 5,756,325; 5,760,012; 5,795,972; and 5,871,984; all of which are herein incorporated by reference. See also, WO 98/49350, WO 99/07865, WO 99/25821, and Beetham et al. (1999) Proc. Natl. Acad. Sci. USA 96:8774-8778; herein incorporated by reference.

It is therefore recognized that methods of the present invention do not depend on the incorporation of the entire polynucleotide into the genome, only that the plant or cell thereof is altered as a result of the introduction of the polynucleotide into a cell. In one embodiment of the invention, the genome may be altered following the introduction of the polynucleotide into a cell. For example, the polynucleotide, or any part thereof, may incorporate into the genome of the plant. Alterations to the genome of the present invention include, but are not limited to, additions, deletions, and substitutions of nucleotides into the genome. While the methods of the present invention do not depend on additions, deletions, and substitutions of any particular number of nucleotides, it is recognized that such additions, deletions, or substitutions comprises at least one nucleotide.

In one embodiment, the activity and/or level of a high oil/high oleic acid DGAT variant, a normal oil DGAT, an AAP1, a PESP, a 40S ribosomal S24 protein, and/or an ABC transporter protein of the invention is increased. An increase in the level and/or activity of the respective polypeptide of the invention can be achieved by providing to the plant a high oil/high oleic acid DGAT variant, a normal oil DGAT, an AAP1, a PESP, a 40S ribosomal S24 protein, and/or an ABC transporter protein. As discussed elsewhere herein, many methods are known the art for providing a polypeptide to a plant including, but not limited to, direct introduction of the polypeptide into the plant, and introducing into the plant (transiently or stably) a polynucleotide construct encoding the respective polypeptide. It is also recognized that the methods of the invention may employ a polynucleotide that is not capable of directing, in the transformed plant, the expression of a protein or an RNA. Thus, the level and/or activity of a high oil/high oleic acid DGAT variant, a normal oil DGAT, an AAP1, a PESP, a 40S ribosomal S24 protein, and/or an ABC transporter protein may be increased by altering the gene encoding the respective polypeptide or its promoter. See, e.g., Kmiec, U.S. Pat. No. 5,565,350; Zarling et al., PCT/US93/03868. Therefore mutagenized plants that carry mutations in the gene encoding a high oil/high oleic acid DGAT variant, a normal oil DGAT, an AAP1, a PESP, a 40S ribosomal S24 protein, and/or an ABC transporter protein, where the mutations increase expression of the respective gene or increase the activity of the encoded high oil/high oleic acid DGAT variant, normal oil DGAT, AAP1, PESP, 40S ribosomal S24 protein, and/or an ABC transporter protein are provided.

A "subject plant or plant cell" is one in which genetic alteration, such as transformation, has been effected as to a gene of interest, or is a plant or plant cell which is descended from a plant or cell so altered and which comprises the alteration. A "control" or "control plant" or "control plant cell" provides a reference point for measuring changes in phenotype of the subject plant or plant cell.

A control plant or plant cell may comprise, for example: (a) a wild-type plant or cell, i.e., of the same genotype as the starting material for the genetic alteration which resulted in the subject plant or cell; (b) a plant or plant cell of the same genotype as the starting material but which has been transformed with a null construct (i.e. with a construct which has no known effect on the trait of interest, such as a construct comprising a marker gene); (c) a plant or plant cell which is a non-transformed segregant among progeny of a subject plant or plant cell; (d) a plant or plant cell genetically identical to the subject plant or plant cell but which is not exposed to conditions or stimuli that would induce expression of the gene of interest; or (e) the subject plant or plant cell itself, under conditions in which the gene of interest is not expressed.

The expression level of a polypeptide and/or an RNA may be measured directly, for example, by assaying for the level of the polypeptide or the RNA in the plant, or indirectly, for example, by measuring the activity of the polypeptide or the RNA in the plant.

In specific embodiments, the recombinant polynucleotide of the invention is introduced into the plant cell. Subsequently, a plant cell having the introduced sequence of the invention is selected using methods known to those of skill in the art such as, but not limited to, Southern blot analysis, DNA sequencing, PCR analysis, or phenotypic analysis. A plant or plant part altered or modified by the foregoing embodiments is grown under plant forming conditions for a time sufficient to modulate the concentration and/or activity of polypeptides of the present invention in the plant. Plant forming conditions are well known in the art and discussed briefly elsewhere herein.

(B) Modulating Oil Content and/or Oleic Content of a Plant or Plant Part

The methods of the invention also provide for modulating the oil content and/or oleic acid content and/or oleic acid/linoleic acid ratio of a plant or plant part thereof. In this manner, one or more high oil- and/or high oleic acid-associated sequences genetically linked to a QTL6 region that is flanked by a first border sequence that comprises nucleotides 1-20 of SEQ ID NO:2 herein and a second border sequence that comprises nucleotides 477-496 of SEQ ID NO:46 herein, or a QTL6 region that is flanked by a first border sequence that comprises nucleotides 1-20 of SEQ ID NO:6 herein and a second border sequence that comprises nucleotides 482-501 of SEQ ID NO:14 herein, or a QTL6 region that is flanked by a first border sequence that comprises nucleotides 1-20 of SEQ ID NO:10 herein and a second border sequence that comprises nucleotides 488-507 of SEQ ID NO:4 herein can be introduced into a plant or plant part thereof to confer the high oil and/or high oleic acid and/or increased oleic acid/linoleic acid ratio phenotype on the plant or plant part thereof. Thus in some embodiments, one or more of the favorable marker loci identified herein are introduced into the plant or plant part thereof by methods well known in the art, including the transformation and breeding methods discussed herein above. In some embodiments, the favorable marker loci comprise the sequences set forth in SEQ ID NOs:2, 4, 6, 8, 10, 12, 14, 16, 18, 20, 22, 24, 26, 28, 30, 32, 34, 36, 38, 40, 42, 44, 46, and 51 with at least one polymorphism contained therein. Examples of specific polymorphisms within each favorable marker locus of the QTL6 region are identified in Table 2 (non-coding marker loci) and Table 3 (marker locus comprising coding sequence) in Examples 2 and 4 herein below. Non-limiting examples of sequences for favorable marker loci of the invention are set forth in SEQ ID NOs:1, 3, 5, 7, 9, 11, 13, 15, 17, 19, 21, 23, 25, 27, 29, 31, 33, 35, 37, 39, 41, 43, 45, and 47, and the respective polymorphism(s) occurring within these favorable marker loci are shown in Tables 2 and 3 herein below. See also the alignments shown in FIGS. 7-29 and 31. Introduction of one or more of these high oil-associated and/or high oleic acid-associated sequences into a plant or plant part thereof can confer the desired phenotype of high oil content and/or high oleic acid content and/or increased oleic acid/linoleic acid ratio.

In other embodiments, the methods of the invention provide for modulation of the oil content and/or the oleic acid content and/or the oleic acid/linoleic acid ratio in a plant or plant part thereof by overexpressing a normal oil DGAT of the present invention. In this manner, an expression cassette comprising a polynucleotide encoding a normal oil DGAT polypeptide of the invention, for example, the ZmDGAT1-2 (EF09B) polynucleotide of SEQ ID NO:51, encoding the ZmDGAT1-2(EF09B) of SEQ ID NO:52, to provide for overexpression of this polypeptide, thereby increasing oil content and/or oleic acid content, and/or oleic acid/linoleic acid ratio within the plant or plant part thereof. Thus in some embodiments, an expression cassette comprising SEQ ID NO:51 or a polynucleotide encoding SEQ ID NO:52 or a biologically active variant or fragment of this polypeptide is introduced into the plant or plant part thereof by methods well known in the art, including the transformation and breeding methods discussed herein above.

In specific embodiments, the plants and plant parts of the invention having the increased oil content finds use in the wet milling industry. In the wet milling process, the purpose is to fractionate the kernel and isolate chemical constituents of economic value into their component parts. The process allows for the fractionation of starch into a highly purified form, as well as, for the isolation in crude forms of other material including, for example, unrefined oil, or as a wide mix of materials which commonly receive little to no additional processing beyond drying. Hence, in the wet milling process grain is softened by steeping and cracked by grinding to release the germ from the kernels. The germ is separated from the heavier density mixture of starch, hulls and fiber by "floating" the germ segments free of the other substances in a centrifugation process. This allows a clean separation of the oil-bearing fraction of the grain from tissue fragments that contain the bulk of the starch. Since it is not economical to extract oil on a small scale, many wet milling plants ship their germ to large, centralized oil production facilities. Oil is expelled or extracted with solvents from dried germs and the remaining germ meal is commonly mixed into corn gluten feed (CGF), a coproduct of wet milling. Hence, starch contained within the germ is not recovered as such in the wet milling process and is channeled to CGF. See, for example, Anderson et al. (1982) *"The Corn Milling Industry"; CRC Handbook of Processing and Utilization in Agriculture*, A. Wolff, Boca Raton, Fla., CRC Press., Inc., Vol. 11, Part 1, *Plant Products:* 31-61 and Eckhoff (Jun. 24-26, 1992) *Proceedings of the 4th Corn Utilization Conference*, St. Louis, Mo., printed by the National Corn Growers Association, CIBA-GEIGY Seed Division, and the USDA, both of which are herein incorporated by reference.

(C) Methods to Improve Feed Quality

Methods are provided to improve the tissue quality of an animal by feeding an animal a diet comprising a plant or plant part of the present invention that has an increased oil content and/or an increased oleic content. Such methods comprise feeding the animal a diet comprising a sufficient amount of a grain or oil of the invention which comprises the increased oil content and/or increased oleic content.

The feed employed in the diet can comprise about 5%, 10%, 20%, 30%, 40%, 50%, 60%, 70%, 80%, 90%, or 100% of the grain of the invention (i.e., a grain comprising a high oil/high oleic variant of DGAT, grain comprising an expression cassette that provides for overexpression of a normal oil DGAT disclosed herein, combinations thereof, and the like). In other embodiments, the feed employed in the diet can comprise about 1 to about 15%, about 10 to about 25%, about 20 to about 35%, about 30 to about 45%, about 40% to about 55%, about 50 to about 65%, about 60 to about 75%, about 70 to about 85%, about 80% to about 95% or about 90% to 100% of the grain of the invention.

The tissue quality of any animal can be improved. Animals of interest include, but are not limited to, ruminant animals, including, but not limited to, cattle, bison, or lamb, as well as, non-ruminant animals including, but not limited to, swine, poultry (i.e., chickens, layer hens, turkey, ostriches and emu) or fish.

In specific embodiments, the plant, plant part, seed, grain, or oil is a constituent of animal feed or a food product. Plants or parts thereof of the present invention can be utilized in methods, for example without limitation, to obtain a seed, meal, feedstock, or oil. Plants utilized in such methods may be processed. Accordingly, the present invention provides seed, grain, feed, and/or oil that are produced from a plant or plant part having an increased oil content and/or increased oleic content and/or increased oleic acid/linoleic acid ratio as described herein. Methods to produce feed, meal, protein and oil preparations from various plant parts are known in the art. See, for example, U.S. Pat. Nos. 4,957,748, 5,100,679, 5,219,596, 5,936,069, 6,005,076, 6,146,669, and 6,156,227. Further provided is meat produced from animals being feed the plant, plant part, grain and/or oil having the increased oil content and/or increased oleic content and/or increased oleic acid/linoleic acid ratio, as described elsewhere herein.

(D) Methods of Use for ZmDGAT1-2, ZmAAP1, ZmPESP, ZmS24, and ZmABCT Promoter Sequences The nucleotide sequence for the ZmDGAT1-2(Mo17), ZmDGAT1-2(ASK), ZmAAP1, ZmPESP(Mo17), ZmPESP (ASK), ZmS24, or ZmABCT promoter disclosed in the present invention, as well as variants and fragments thereof, are useful in the genetic manipulation of any plant when assembled with a DNA construct such that the promoter sequence is operably linked to a heterologous nucleotide sequence encoding a protein of interest. In this manner, the nucleotide sequence of the ZmDGAT1-2(Mo17), ZmDGAT1-2(ASK), ZmAAP1, ZmPESP(Mo17), ZmPESP (ASK), ZmS24, or ZmABCT promoter of the invention is provided in expression cassettes along with heterologous nucleotide sequences for expression in the plant of interest.

Synthetic hybrid promoter regions are known in the art. Such regions comprise upstream promoter elements of one nucleotide sequence operably linked to the promoter element of another nucleotide sequence. In an embodiment of the invention, heterologous gene expression is controlled by a synthetic hybrid promoter comprising the ZmDGAT1-2 (Mo17), ZmDGAT1-2(ASK), ZmAAP1, ZmPESP(Mo17), ZmPESP(ASK), ZmS24, or ZmABCT promoter sequence of the invention, or a variant or fragment thereof, operably linked to upstream promoter element(s) from a heterologous promoter. Upstream promoter elements have been identified and may be used to generate a synthetic promoter. See, for example, Rushton et al. (1998) Curr. Opin. Plant Biol. 1:311-315. Alternatively, a synthetic ZmDGAT1-2(Mo17), ZmDGAT1-2(ASK), ZmAAP1, ZmPESP(Mo17), ZmPESP (ASK), ZmS24, or ZmABCT promoter sequence may comprise duplications of the upstream promoter elements found within the ZmDGAT1-2(Mo17), ZmDGAT1-2(ASK), ZmAAP1, ZmPESP(Mo17), ZmPESP(ASK), ZmS24, or ZmABCT promoter sequence. It is recognized that the ZmDGAT1-2(Mo17), ZmDGAT1-2(ASK), ZmAAP1, ZmPESP (Mo17), ZmPESP(ASK), ZmS24, or ZmABCT promoter sequence of the invention may be used with its native ZmDGAT1-2(Mo17), ZmDGAT1-2(ASK), ZmAAP1, ZmPESP, ZmS24, or ZmABCT coding sequence. A DNA construct comprising the ZmDGAT1-2(Mo17), ZmDGAT1-2(ASK), ZmAAP1, ZmPESP(Mo17), ZmPESP(ASK), ZmS24, or ZmABCT promoter operably linked with its native ZmDGAT1-2(Mo17), ZmDGAT1-2(ASK), ZmAAP1, ZmPESP, ZmS24, or ZmABCT coding sequence may be used to transform any plant of interest to bring about a desired phenotypic change. Where the promoter and its native gene are naturally occurring within the plant, i.e., in maize, transformation of the plant with these operably linked sequences also results in either a change in phenotype, such as increased oil content, increased oleic acid content, and/or increased oleic acid/linoleic acid ratio, or the insertion of operably linked sequences within a different region of the chromosome thereby altering the plant's genome.

In another embodiment of the invention, expression cassettes will comprise a transcriptional initiation region comprising the ZmDGAT1-2(Mo17), ZmDGAT1-2(ASK), ZmAAP1, ZmPESP(Mo17), ZmPESP(ASK), ZmS24, or ZmABCT promoter nucleotide sequence disclosed herein, or a variant or fragment thereof, operably linked to the heterologous nucleotide sequence whose expression is to be controlled by the ZmDGAT1-2(Mo17), ZmDGAT1-2(ASK), ZmAAP1, ZmPESP(Mo17), ZmPESP(ASK), ZmS24, or ZmABCT promoter of the invention.

The promoter nucleotide sequence and methods disclosed herein are useful in regulating expression of any heterologous nucleotide sequence in a host plant in order to vary the phenotype of a plant. Various changes in phenotype are of interest including modifying the fatty acid composition in a plant, altering the amino acid content of a plant, altering a plant's pathogen defense mechanism, and the like. These results can be achieved by providing expression of heterologous products or increased expression of endogenous products in plants. Alternatively, the results can be achieved by providing for a reduction of expression of one or more endogenous products, particularly enzymes or cofactors in the plant. These changes result in a change in phenotype of the transformed plant.

The following examples are offered by way of illustration and not by way of limitation.

EXPERIMENTAL

Example 1

Oil/Oleic Acid QTL6 Mapping and Sequence Information

ASKC28IB1, an inbred line derived from cycle 28 of Alexho Single-Kernel synthetic (ASK) population was used as a high oil donor and EF09B as a recurrent parent in a series of continuous backcrossing populations. For initial oil QTL mapping, 300 BC1 kernels were planted, leaf disks collected from each seedling, and DNA was extracted. Genome-wide genotyping was performed with all individual seedlings using 100 SSR markers evenly distributed on 10 maize chromosomes. All 300 BC1 plants were backcrossed with EF09B to yield BC2 seeds. Ten to 20 kernels from each mature BC2 ear were analyzed by NMR to determine the amount of oil as well as the concentration of oil on per kernel or per embryo bases. For seed oil, air-dried kernels were used for direct NMR measurements. For embryo oil, kernels were soaked in water overnight. Embryos were dissected from endosperms, vacuum-dried and subjected to NMR analysis.

Mapping was performed using marker data from BC1 seedlings and oil data from BC2 ears. Composite interval mapping of oil traits were performed using Windows QTL Cartographer program (Wang et al. North Carolina State University). QTL significance level for each trait was determined by 300 permutations at $p<0.05$.

Figure 1:
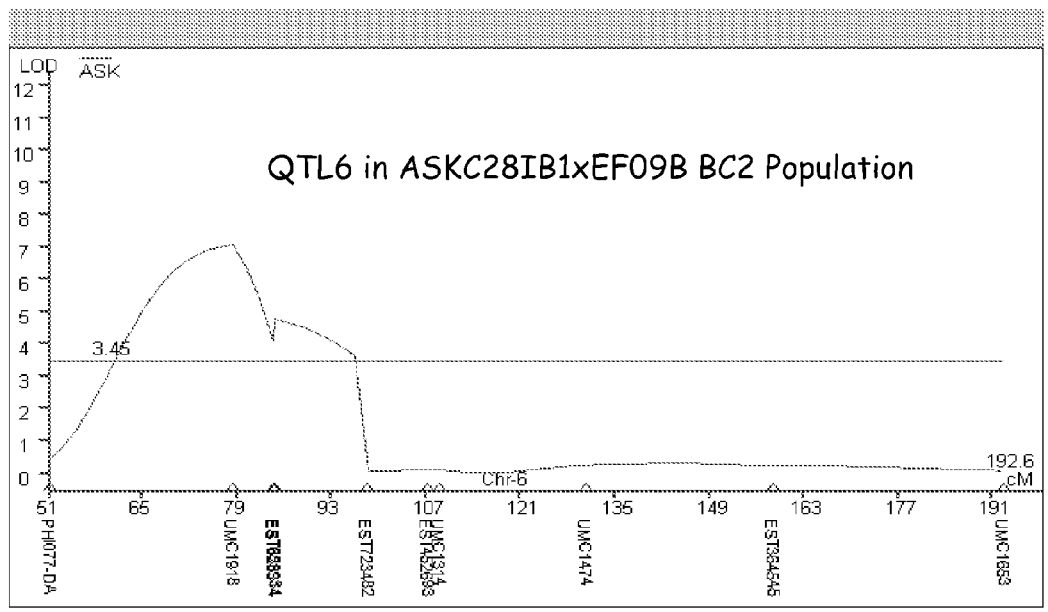
FIG. 1 shows mapping of QTL6 in a BC2 population.

A significant embryo oil and kernel oil QTL was detected on chromosome six (QTL6). Mapping results derived from embryo oil concentration are shown in FIG. 1. QTL6 is located between markers PHI077 (51.2 cM, IBM2+, single meiosis map) and EST723482 (98.4 cM) and with a peak value around UMC1918 (FIG. 1). These results are consistent with those of Zhong and Williams (2003, data not shown) obtained from a mapping study in an F2 population derived from a cross between ASKC28IB1 and H31 inbred.

Figure 2:
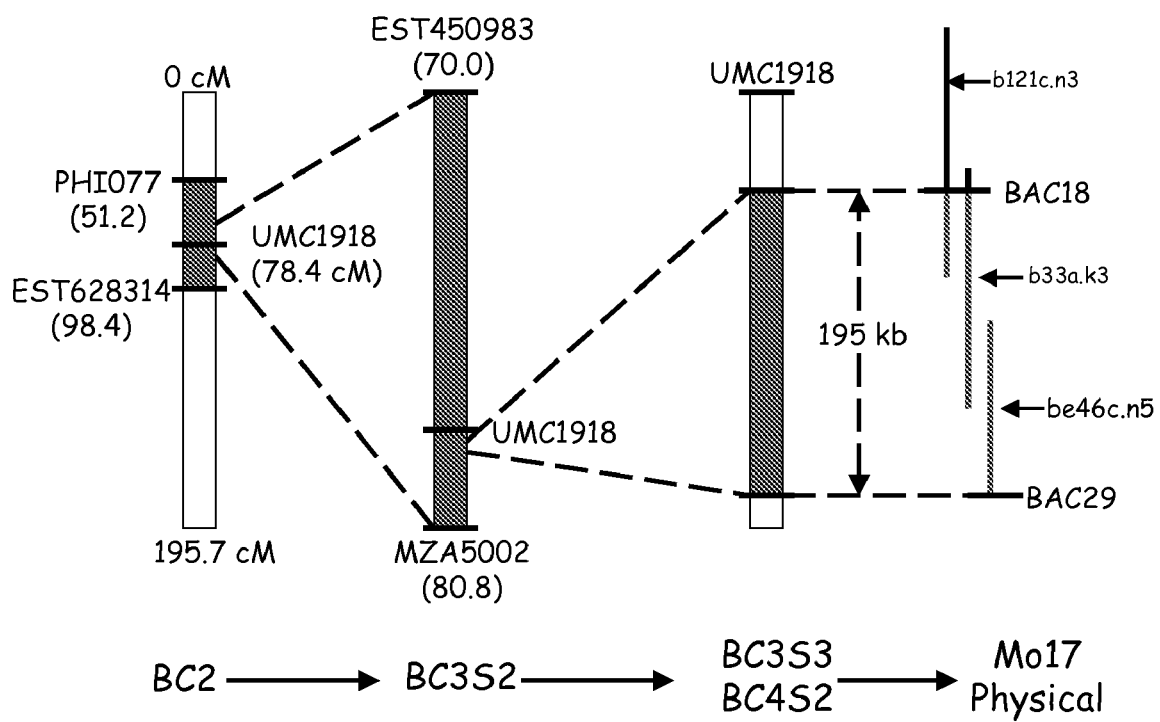
FIG. 2 is a schematic drawing illustrating the progressive mapping of QTL6 from a region of 47.2 cM in BC2 down to a fragment of approximately 195 kb in BC4S2, which corresponds to three overlapping BAC clones (b121c.n3, b33a.k3 and be46c.n5) in the physical map from Mo17 inbred.

Fine mapping of QTL6 was achieved using overlapping near-isogenic lines developed around the QTL6 region (FIG. 2). Recombinant events between PHI077 and EST723482 were identified from various stages and self-pollinated for two or more generations to produce near-isogenic lines (NILs). Series of overlapping near NILs were developed in BC3S2, BC3S3 and BC4S2. In the subsequence backcrossing and self-pollinated generations, genome-wide marker-assisted selection (MAS) was applied at each generation to accelerate the selection of individuals that only contain ASKC28IB1 genome in the QTL6 region. It was estimated that many individuals selected for NIL development contained greater than 97.5% and 99% of their genomes from the EF09B parent for BC3 and BC4 respectively.

In order to map QTL6 to a much higher resolution, additional SSR or SNP markers around the QTL6 region were also developed using proprietary sequence information or public BAC end sequence information. Markers used in this project, and some markers around this region used and published by various authors, are shown in Table 1 below.

TABLE 1

Markers used to fine map oil/oleic QTL6.

| | Pioneer Proprietary | Marker Type | Chrom # | IBM2 + SM | IBM2 + Neighbors | Diversity | Reference |
|---|---|---|---|---|---|---|---|
| PHI077 | Y | SSR | 6 | 51.2 | 98.4 | 101.7 | |
| UMC1133 | N | Microsatellite | 6 | 51.2 | 98.6 | 104.4 | 1 |
| UMC1595 | N | SSR | 6 | 65 | 153.7 | 213.6 | 2 |
| MZA10275 | Y | SNP | 6 | 66.5 | 158.7 | 230.8 | |
| MZA6770 | Y | SNP | 6 | | | 230.8 | |
| MZA8079 | Y | SNP | 6 | | | 231.6 | |
| EST450983 | Y | SSR | 6 | 70 | 166.6 | 261.1 | |
| MZA9164 | Y | SNP | 6 | 70.2 | 166.8 | 246.5 | |
| MZA11710 | Y | SNP | 6 | 70.2 | 166.8 | 247.8 | |
| MZA11918 | Y | SNP | 6 | | | 259.3 | |
| MZA10187 | Y | SNP | 6 | 70.2 | 166.8 | 261.1 | |
| UMC65 | N | RFLP | 6 | 75.6 | 181.9 | | 3 |
| BAC02 | Y | SNP | 6 | | | | |
| UMC1918 | N | SSR | 6 | 78.4 | 189.9 | 268.1 | |
| BNLG480 (ZCA480) | N | SSR | 6 | | 196.1 | | 4 |
| BAC05 | Y | SNP | 6 | | | | |
| BAC20 | Y | SNP | 6 | | | | |
| BAC18 | Y | SNP | 6 | | | | |
| QTL6SNP7 | Y | SNP | 6 | | | | |
| BAC22 | Y | SNP | 6 | | | | |
| BAC24 | Y | SNP | 6 | | | | |
| BAC17 | Y | SNP | 6 | | | | |
| QTL6SNP8 | Y | SNP | 6 | | | | |
| QTL6SNP9 | Y | SNP | 6 | | | | |
| QTL6SNP13 | Y | SNP | 6 | | | | |
| QTL6SNP14 | Y | SNP | 6 | | | | |
| QTL6SNP15 | Y | SNP | 6 | | | | |
| QTL6SNP16 | Y | SNP | 6 | | | | |
| QTL6SNP17 | Y | SNP | 6 | | | | |
| BAC32 | Y | SNP | 6 | | | | |
| BAC29 | Y | SNP | 6 | | | | |
| MZA5002 | Y | SNP | 6 | 80.8 | 199 | 274.4 | |
| MZA13321 | Y | SNP | 6 | | | 274.4 | |
| MZA15785 | Y | SNP | 6 | 80.8 | 199 | 274.9 | |
| MZA13118 | Y | SNP | 6 | 80.8 | 199 | 274.9 | |
| MZA11771 | Y | SNP | 6 | 80.8 | 199 | 289.2 | |
| UMC1857 | N | SSR | 6 | 81.4 | 203.2 | 275.3 | |
| MZA9351 | Y | SNP | 6 | | | 277.0 | |
| MZA8135 | Y | SNP | 6 | 84.5 | 211.5 | 278.2 | |
| NC009 | N | SSR | 6 | 84.5 | 211.5 | 278.2 | 4 |
| UMC1014 | N | SSR | 6 | 84.5 | 211.5 | 278.2 | 4 |
| MZA15691 | Y | SNP | 6 | | | 291.1 | |
| MZA8616 | Y | SNP | 6 | | | 294.2 | |
| MZA146 | Y | SNP | 6 | 84.5 | 211.5 | 294.8 | |
| MZA18413 | Y | SNP | 6 | 84.5 | 211.5 | 302.2 | |
| MZA8593 | Y | SNP | 6 | 84.5 | 211.5 | 304.6 | |
| EST653931 | Y | SSR | 6 | 84.5 | 211.5 | 304.6 | |
| EST628314 | Y | SSR | 6 | 84.5 | 211.5 | 334.4 | |
| UMC2319 | N | SSR | 6 | 96.7 | 244.9 | | 2 |
| EST723482 | Y | SSR | 6 | 98.4 | 253 | 330.6 | |
| UMC1614 | N | Microsatellite | 6 | 103.4 | 236 | | 1 |
| MZA13718 | Y | SNP | 6 | | | 316.8 | |

Markers in black are Pioneer SSR or SNP markers used in QTL6 mapping. They are either developed from Pioneer proprietary sequences (Y) or from public sequences (N). If known, map positions are given in three different maps, IBM2+ single meiosis (V1.5); IBM2+ Neighbors (V1.6) and Pioneer Diversity (V1.4).
Markers in various colors are cited from references given below:
1. Mangolin et al, 2004. Mapping QTLs for kernel oil content in a tropical maize population. Euphytica. 137: 251-259.
2. Song et al, 2004. QTL mapping of kernel oil concentration with high-oil maize by SSR markers. Maydica. 49: 41-48.
3. Alrefai et al, 1995. Quantitative trait locus analysis of fatty acid concentration in maize. Genome 38: 894-901.
4. Johnson & Rocheford, 2003. Evaluation of Near-Isogenic Lines for QTL for kernel concentration in maize. Illinois Corn Breeder's School pages 126-149.

Oil-related data were obtained from the overlapping NILs and sorted according to different marker classes. For each NIL pair, oil data and fatty acid profiles were obtained from five ears homozygous for ASK allele (QTL6+/+) and five ears homozygous for EF09B allele (QTL6−/−). Data from QTL6+/+class and QTL6−/− class were compared and a significant difference at p<0.01 between homozygous ASK class (QTL6+/+) and homozygous EF09B class (QTL6−/−) suggested the presence of QTL6. In BC3S2, QTL6 was mapped to a region of 10.8 cM (between markers EST450983 and MZA5002). In BC3S3 and BC4S2, QTL6 was mapped further to a small region between markers BAC18 and BAC29 (FIG. 2). This region corresponds to three overlapping BAC clones (b121c.n3, b33a.k3 and be46c.n5) in the physical map of Mo17 inbred. Sequences of these three BACs were determined and the total genomic insert in the three clones is approximately 280 kb. The genomic inserts in the 3 Mo17 BAC clones sequenced are presented in three separate genomic fragments, SEQ ID NO:116, SEQ ID NO:117, and SEQ ID NO:118 due to some unresolved gaps.

The largest fragment, SEQ ID NO:116, is 263762-bp in length and contains ORFs for K+ Efflux System Protein (ZmPESP; protein shown in SEQ ID NO:57, coding sequence (cDNA) shown in SEQ ID NO:56), ZmDGAT1-2(Mo17) protein shown in SEQ ID NO:50, coding sequence (cDNA) shown in SEQ ID NO:49), and PDR-like ABC transporter (ZmABCT; protein shown in SEQ ID NO:64, coding sequence (cDNA) shown in SEQ ID NO:63). Thus nucleotides (nt) 153888-156887 of SEQ ID NO:116 represent the ZmPESP(Mo17) promoter (set forth in SEQ ID NO:121); nt 156888-165958 of SEQ ID NO:116 represent the coding sequence (exon plus intron sequences) for ZmPESP; nt 165959-166382 of SEQ ID NO:116 represent ZmPESP 3'-UTR sequence; the complementary strand to nt 173344-176343 of SEQ ID NO:116 represents the ZmDGAT1-2 (Mo17) promoter (complementary strand to this promoter is set forth in SEQ ID NO:119); the complementary strand to nt 167385-173343 of SEQ ID NO:116 represents the coding sequence (exon plus intron sequences) for ZmDGAT1-2 (Mo17); the complementary strand to nt 167035-167384 of SEQ ID NO:116 represents the ZmDGAT1-2(Mo17) 3'-UTR sequence; nt 254826-257825 of SEQ ID NO:116 represent the ZmABCT promoter (set forth in SEQ ID NO:124); nt 257826-263762 of SEQ ID NO:116 represent the partial coding sequence (exon plus intron sequences) for ZmABCT; and nt 167035-167384 of SEQ ID NO:116 represent the ZmABCT 3'-UTR sequence.

The second fragment (SEQ ID NO:117) is 11915 bp and contains ORFs for 40S ribosomal protein (ZmS24; protein shown in SEQ ID NO:60, coding sequence (cDNA) shown in SEQ ID NO:59) and amino acid permease (ZmAAP1; protein shown in SEQ ID NO:56, coding sequence (cDNA) shown in SEQ ID NO:55). Thus, nt 1824-4823 of SEQ ID NO:117 represent the ZmS24 promoter (set forth in SEQ ID NO:123); nt 4824-5994 of SEQ ID NO:117 represent the ZmS24 coding sequence (exon plus intron sequences); nt 5995-6160 of SEQ ID NO:117 represent the ZmS24 3'UTR sequence; nt 6161-6888 of SEQ ID NO:117 represent the ZmAAP1 promoter (set forth in SEQ ID NO:120); nt 6889-8556 of SEQ ID NO:117 represent the ZmAAP1 coding sequence (exoon plus intron sequences); and nt 8557-8822 of SEQ ID NO:117 represent the ZmAAP1 3'UTR sequence.

The third fragment (SEQ ID NO:118) is 6368 bp and does not contain ORFs.

The ASKC28IB1 genomic sequence for the QTL6 region was also obtained. A BAC library was constructed using DNA isolated from ASKC28IB1 leaves and screened using BAC17 sequence (SEQ ID NO:3) as a probe. One of the positive BAC clones (ASKBAC clone F4) was sequenced and annotated. The insert in this clone is 82725 base pairs (SEQ ID NO:128) and contains two genes, PESP and DGAT1-2. The other three genes (S24, AAP, and ABCT) found in the Mo17 BACs were outside of the region covered by the F4 clone. Nucleotide positions for promoter, coding, and 3'UTR for both PESP and DGAT1-2 genes in the ASKC28IB1 BAC clone are described below.

The 82725-bp ASKC28IB1 (ASK) genomic sequence (SEQ ID NO:128) contains the ORF for the ZmPESP protein shown in SEQ ID NO:57 (coding sequence (cDNA) shown in SEQ ID NO:56) and the ZmDGAT1-2(ASK) protein shown in SEQ ID NO:48 (coding sequence (cDNA) shown in SEQ ID NO:47). Thus, nucleotides (nt) 9306-12305 of SEQ ID NO:128 represent the ZmPESP(ASK) promoter (set forth in SEQ ID NO:129); nt 12306-21370 of SEQ ID NO:128 represent the coding sequence (exon plus intron sequences) for ZmPESP; nt 21371-21794 of SEQ ID NO:128 represent ZmPESP 3'-UTR sequence; the complementary strand to nt 29472-32471 of SEQ ID NO:128 represents the ZmDGAT1-2(ASK) promoter (complementary strand to this promoter is set forth in SEQ ID NO:130); the complementary strand to nt 22774-29471 of SEQ ID NO:128 represents the coding sequence (exon plus intron sequences) for ZmDGAT1-2 (ASK); and the complementary strand to nt 22365-22773 of SEQ ID NO:128 represents the ZmDGAT1-2(ASK) 3'-UTR sequence.

QTL6 can be further defined to a fragment of approximately 195 kb, between BAC18 and BAC29 (FIG. 2).

Oil data from these NILs show that QTL6 consistently increases embryo and seed oil concentrations in multiple generations. BC3S2 and BC4S2 oil data are summarized in FIG. 3. QTL6 increases embryo oil concentration from 31.6 to 35.8% (a 13% increase) in BC3S2 and from 28.7 to 33.3% (a 16% increase) in BC4S2. It also increases seed oil concentration from 4.4 to 5.1% (a 17% increase) in BC3S2 and from 3.7 to 4.4% (a 19% increase) in BC4S2. It is generally believed that high oil corn also contains increased level of oleic acid (18:1). In addition, a major QTL controlling the ratio of oleic (18:1) and linoleic acid (18:2) was mapped on chromosome 6 by different groups (Alrefai et al. (1995) *Genome* 38:894-901; Poneleit et al. (1976) *Agron. Abs.* 8:59).

The present study investigated whether the NILs developed for QTL6 also contained increased levels of oleic acid. Fatty acid profiles for homozygous ASK and EF09B classes in BC3S2, BC3S2, and BC4S2 seeds were obtained. Data from BC3S2 and BC4S2 are summarized in FIG. 4. Indeed QTL6 also consistently increases oleic acid concentration in seeds in multiple generations. In BC3S2, QTL6 increases oleic acid concentration from 24.6 to 36.2% (a 47% increase) and decreases linoleic acid concentration from 58.5 to 46.4% (a 21% decrease). In BC4S2, QTL6 increases oleic acid concentration from 23.6 to 37.9% (a 61% increase) and decreases linoleic acid concentration from 59.8 to 45.4% (a 24% decrease). Although fatty acid concentrations in the embryos were not directly measured, it is reasonable to assume most of the changes observed are due to changes in the embryos as embryo oil accounts for approximately 90% of total seed oil. At the 195-kb mapping resolution, increased-oil and increased-oleic acid phenotypes did not segregate, suggesting that genes responsible both phenotypes are both located within the 195-kb region.

In theory, corn with higher oil content beyond QTL6 can be produced by molecularly or genetically stacking QTL6 with other oil QTL or other genes known to increase oil. Maize leafy cotyledon 1 (LEC1) is a B-domain transcription factor (see FIGS. 38 and 39) previously shown to increase embryo oil (see FIG. 5). To determine whether LEC1 can increase embryo oil further, a BC2S2 line homozygous for QTL6 derived from the ASKC28IB1xEF09B population was crossed with homozygous plants containing the maize LEC1 transgene. Embryo and seed oil from the resulting F1 plants were analyzed and data were compared to those obtained from plants carrying QTL6 or LEC1 alone. The results indicate that QTL6 and LEC1 have additive effects on embryo as well as seed oil concentrations and genetically stacking LEC1 and QTL6 can elevate embryo oil concentration to about 40% and seed oil concentration to about 6% even in heterozygous plants (FIG. 5).

Figure 6:
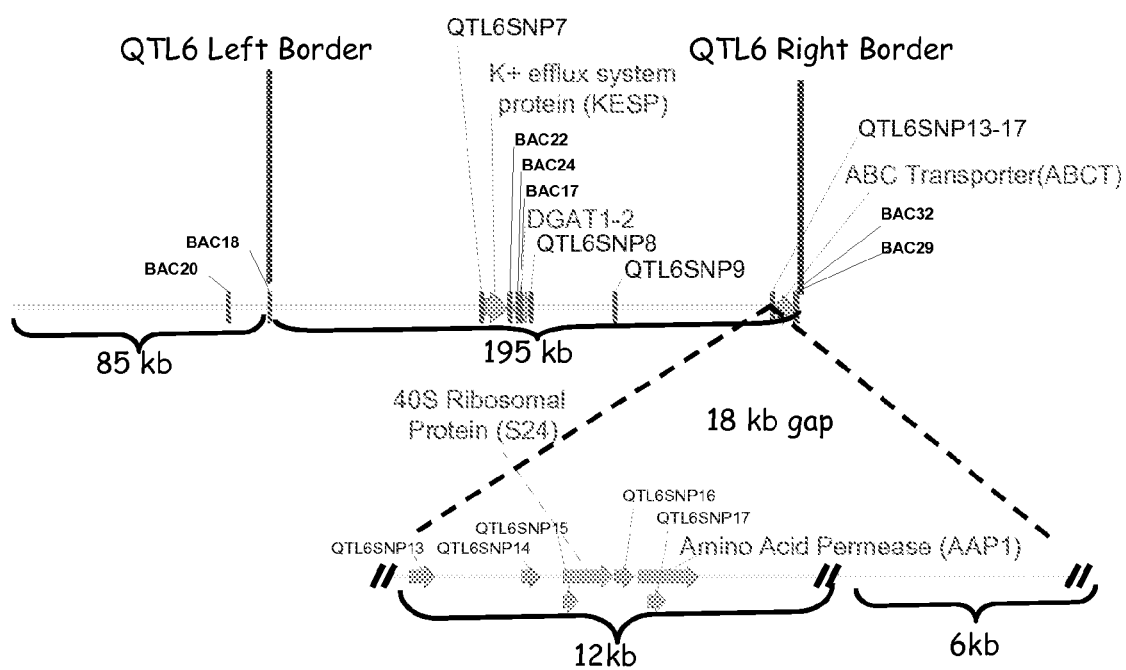
FIG. 6 provides a schematic mapping of the QTL6 region, including the five Open Reading Frames (ORFs). As described in FIG. 2, a major oil/oleic acid QTL has been finely mapped to a small region on chromosome 6 located between SNP markers BAC18 and BAC29. Three overlapping BACs covering QTL6 region from Mo17 inbred maize line were sequenced. The total genomic insert in these three clones is approximately 280 kb. QTL6 can be further mapped to a 195-kb region that contains five open reading frames (ORFs) sharing significant homology with known genes. The five ORFs and closely linked polymorphic markers are labeled. Due to the repetitive nature of the maize genome, some small gaps and orientation of some fragments are to be resolved. Two of the ORFs (40S ribosomal protein and amino acid permease) are located within an 18-kb gap. The ABC transporter ORF is located at the end of the region sequenced, and only the 5'-end half of this large ORF (more than 1500 AA) for the ABC-transporter is located within these three BACs.
Figure 9:
FIG. 9 provides an alignment of the molecular marker QTL6 BAC18 developed from BAC end sequences of the three Mo17 BAC sequences covering the QTL6 region. The BAC 18-ASK marker (SEQ ID NO:5) is aligned with the corresponding sequence from BAC18-EF09B (SEQ ID NO:6). The alignment also provides the forward primer (SEQ ID NO:72) and the reverse primer (SEQ ID NO:73) that can be used to amplify this marker.
Figure 14:
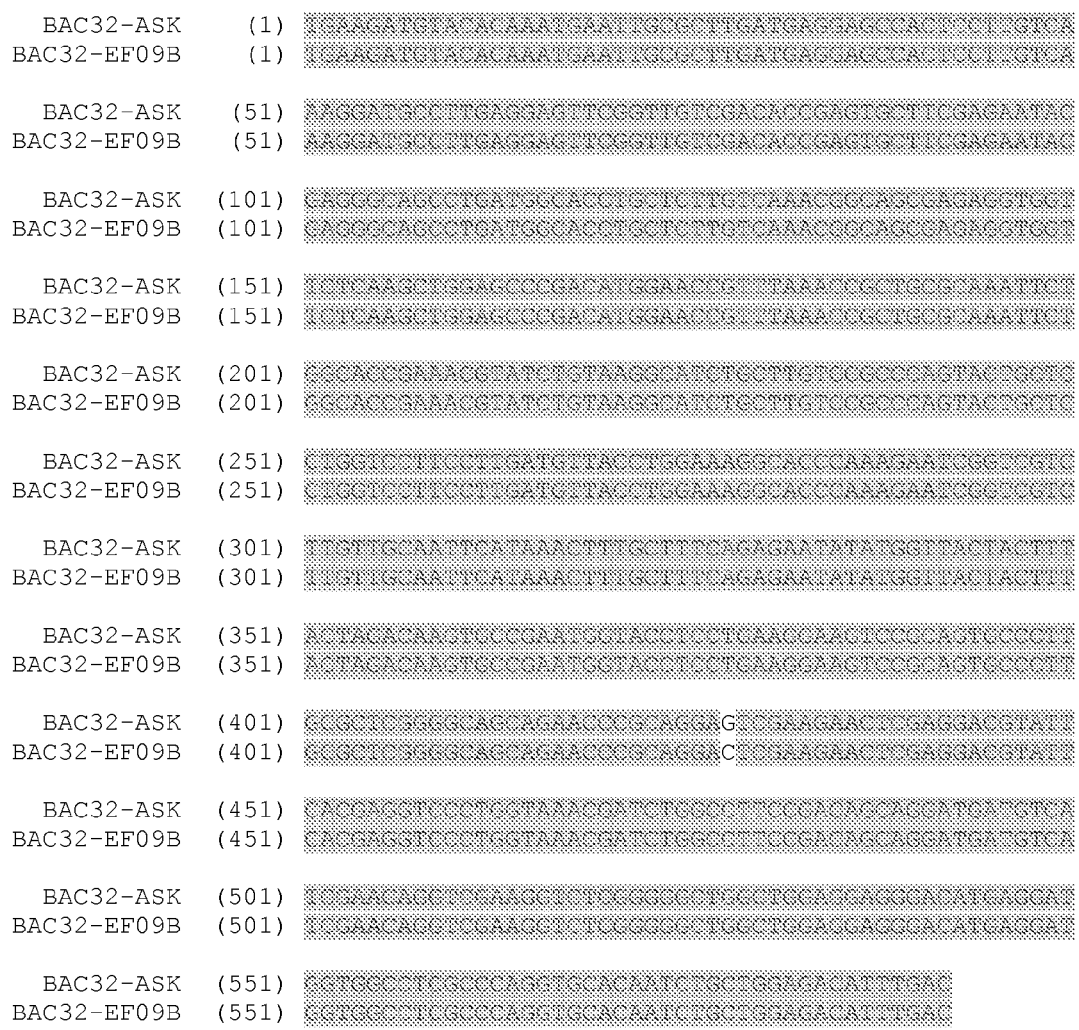
FIG. 14 provides an alignment of the molecular marker QTL6 BAC32 developed from BAC end sequences of the three Mo17 BAC sequences covering the QTL6 region. The BAC32-ASK marker (SEQ ID NO:15) is aligned with the corresponding sequence from BAC32-EF09B (SEQ ID NO:16). The alignment also provides the forward primer (SEQ ID NO:82) and the reverse primer (SEQ ID NO:83) that can be used to amplify this marker.
Figure 25:
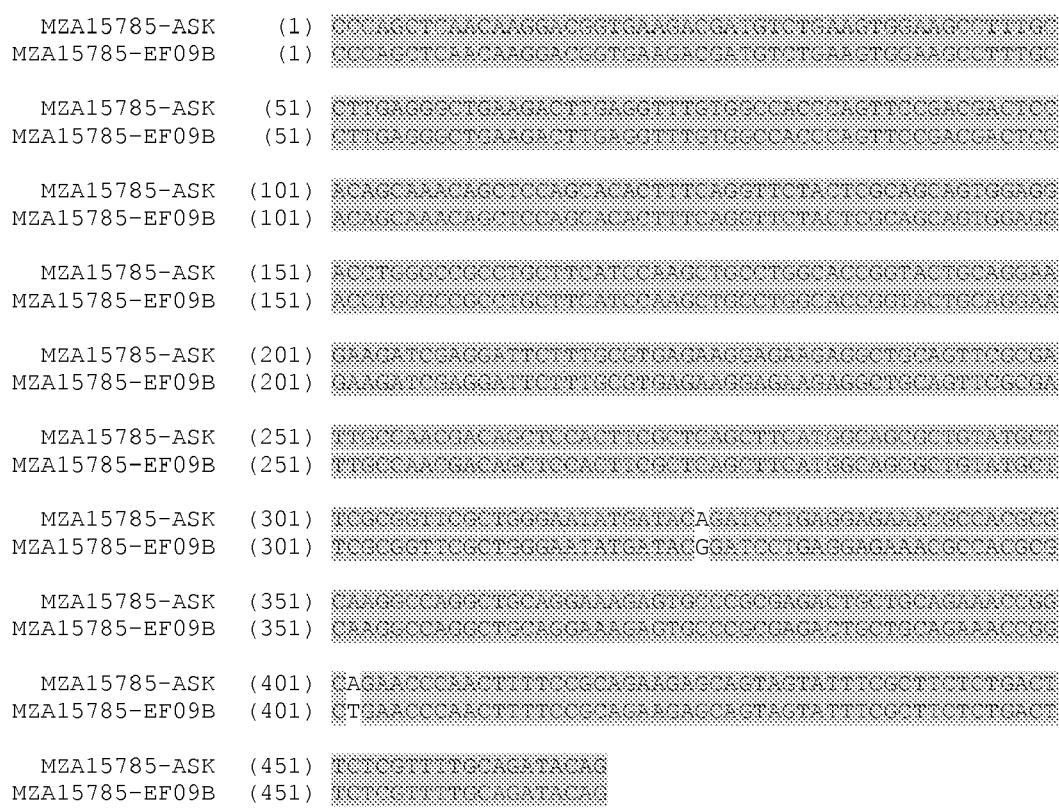
FIG. 25 provides an alignment of the molecular marker QTL6MZA15785 developed from BAC end sequences of the three Mo17 BAC sequences covering the QTL6 region. The QTL6MZA15785-ASK marker (SEQ ID NO:37) is aligned with the corresponding sequence from QTL6MZA15785-EF09B (SEQ ID NO:38). The alignment also provides the forward primer (SEQ ID NO:104) and the reverse primer (SEQ ID NO:105) that can be used to amplify this marker.
Figure 26:
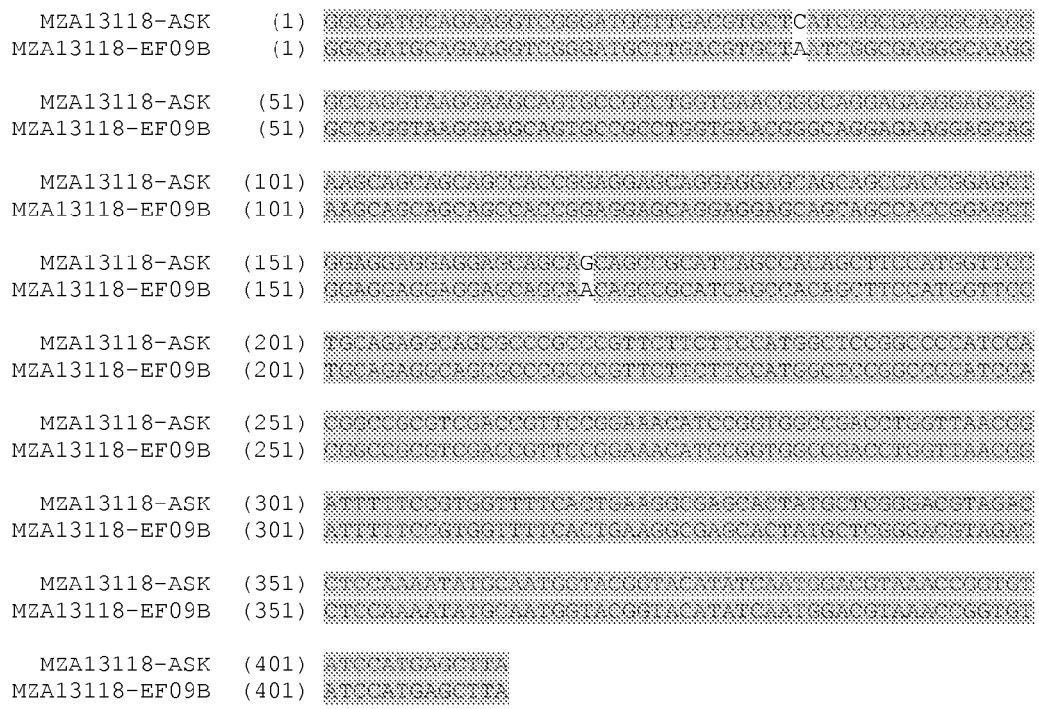
FIG. 26 provides an alignment of the molecular marker QTL6MZA13118 developed from BAC end sequences of the three Mo17 BAC sequences covering the QTL6 region. The QTL6MZA13118-ASK marker (SEQ ID NO:39) is aligned with the corresponding sequence from QTL6MZA13118-EF09B (SEQ ID NO:40). The alignment also provides the forward primer (SEQ ID NO:106) and the reverse primer (SEQ ID NO:107) that can be used to amplify this marker.
Figure 27:
FIG. 27 provides an alignment of the molecular marker QTL6MZA11771 developed from BAC end sequences of the three Mo17 BAC sequences covering the QTL6 region. The QTL6MZA11771-ASK marker (SEQ ID NO:41) is aligned with the corresponding sequence from QTL6MZA11771-EF09B (SEQ ID NO:42). The alignment also provides the forward primer (SEQ ID NO:108) and the reverse primer (SEQ ID NO:109) that can be used to amplify this marker.

To identify the gene(s) responsible for increased oil and oleic acid in QTL6, the three Mo17 BAC clones (b121c.n3, b33a.k3 and be46c.n5) were sequenced and annotated. FGENESH Program (Softberry, Inc. 116 Radio Circle, Suite 400 Mount Kisco, N.Y. 10549) was used to predict genes located within the three BAC clones. In the region between BAC18 and BAC29 (approximately 195 kb), five open reading frames (ORFs) sharing significant homology with known genes were identified. They encode a K+ Efflux System Protein (PESP), a type-1 diacylgycerol O-acyltransferase (DGAT1-2), a 40S ribosomal protein S24, an amino acid permease (AAP) and a PDR-like ABC transporter (ABCT). The five ORFs and some closely linked markers are shown in FIG. 6.

It is well known that DGAT is involved in the last step of biosynthesis of triacyglycerol (TAG). The cDNA sequences for the DGAT gene (DGAT1-2) located in the QTL6 region from several different inbreds was obtained, including ASKC28IB1, EF09B, Mo17, and B73. B73 allele sequence was derived from existing Pioneer EST clones. Mo17 allele sequence was deduced from the BAC clone sequences described above. ASKC28IB1 and EF09B allele sequences were cloned from immature embryos by RT-PCR. Briefly, total RNA was extracted from BC4S2 NIL pairs homozygous for ASK (QTL6+/+) or EF09B (QTL6−/−). First strand cDNA was synthesized using poly(dT) primers. Full-length cDNA was PCR-amplified from the 1$^{st}$ strand cDNA using the following primers: forward primer, 5'-ctggaaccttcctcg-catggccccg (94784) (SEQ ID NO:114); reverse primer 5'-ctatctacttgcctgggcctgcctgttc (94785) (SEQ ID NO:115). DNA sequence alignment of these four alleles is shown in FIG. 31. At the nucleotide level, ASK and normal alleles have changes in nine locations and the changes at four of these locations lead to changes in amino acids (FIG. 30). More detailed analyses of these changes are presented in Example 4 herein below.

Example 2

Marker and Primer Information

Single nucleotide polymorphic (SNP) markers were developed from BAC end sequences of the three Mo17 BAC sequences covering the QTL6 region. Non-limiting examples of polymorphic markers between ASKC28IB1 (ASK; a high-oil, high-oleic acid line) and EF09B (normal oil line) alleles are set forth in FIGS. 11-25. Table 2 below shows the polymorphism(s) unique to the QTL6 markers of ASK that are not found in the corresponding marker locations within the QTL6 region from the normal oil lines (SEQ ID NO for EF09B is used as the reference sequence).

TABLE 2

Location of polymorphisms within marker loci of the maize QTL6 region.

| Marker Locus | SEQ ID NO: | NT | Polymorphic Change |
|---|---|---|---|
| QTL6 BAC05 | 2 | 34 | G → A |
| | | 35 | C → T |
| | | 73 | C → T |
| | | 74 | A → G |
| | | 90 | G → C |
| | | 110 | C → T |
| | | 122 | deletion of A |
| | | 123 | deletion of T |
| | | 137 | T → G |
| | | 138 | C → T |
| | | 185 | C → G |
| | | 186 | A → G |
| | | 194 | G → C |
| | | 214 | A → G |
| | | 230 | T → C |
| | | 256 | A → T |
| | | 336 | T → C |
| | | 359 | G → C |
| | | 373 | insertion of A |
| | | 403 | T → A |
| | | 449 | T → C |
| | | 481 | C → A |
| | | 495 | T → C |
| QTL6 BAC17 | 4 | 28 | C → T |
| | | 204 | A → C |
| | | 256 | G → A |
| | | 302 | A → T |
| | | 305 | A → C |
| | | 341 | G → C |
| | | 429 | C → G |
| | | 461 | C → G |
| QTL6 BAC18 | 6 | 43 | C → A |
| | | 74 | C → T |
| | | 208 | A → C |
| | | 224 | A → G |
| QTL6 BAC20 | 8 | 25 | A → G |
| | | 55 | G → A |
| | | 88 | C → T |
| | | 100 | G → A |
| | | 195 | C → T |
| | | 223 | A → G |
| | | 238 | T → C |
| | | 242 | C → T |
| | | 255 | T → C |
| | | 279 | A → G |
| | | 306 | T → C |
| | | 307 | insertion of 79 nucleotides |
| | | 345 | T → C |
| | | 399 | G → A |
| QTL6 BAC22 | 10 | 40 | deletion of A |
| | | 41 | deletion of C |
| | | 88 | A → C |
| | | 89 | C → G |
| | | 126 | C → T |
| | | 134 | T → A |
| | | 146 | C → A |
| | | 218 | deletion of G |
| QTL6 BAC24 | 12 | 128 | T → C |
| | | 195 | T → C |
| | | 256 | G → A |
| | | 257 | T → A |
| | | 293 | deletion of C |
| | | 294 | deletion of C |
| | | 295 | deletion of T |
| | | 296 | deletion of T |
| | | 327 | C → A |
| QTL6 BAC29 | 14 | 262 | T → C |
| | | 311 | G → A |
| QTL6 BAC32 | 16 | 428 | C → G |
| QTL6SNP7 | 18 | 119 | C → A |
| | | 396 | C → G |
| | | 420 | G → A |
| QTL6SNP8 | 20 | 194 | A → T |
| | | 258 | deletion of G |

TABLE 2-continued

Location of polymorphisms within marker loci of the maize QTL6 region.

| Marker Locus | SEQ ID NO: | NT | Polymorphic Change |
|---|---|---|---|
| | | 259 | deletion of G |
| | | 260 | deletion of G |
| | | 365 | C → G |
| | | 366 | C → G |
| | | 489 | A → G |
| QTL6SNP9 | 22 | 48 | A → C |
| | | 50 | G → A |
| | | 56 | deletion of T |
| | | 60 | A → G |
| | | 63 | C → T |
| | | 101 | T → C |
| | | 133 | C → T |
| | | 166 | deletion of C |
| | | 170 | G → A |
| | | 179 | A → G |
| | | 181 | insertion of 2 nucleotides (AC) |
| | | 206 | deletion of G |
| | | 207 | deletion of A |
| | | 211 | T → C |
| | | 231 | T → G |
| | | 237 | A → G |
| | | 255 | insertion of T |
| | | 273 | T → C |
| | | 282 | G → A |
| | | 294 | C → G |
| | | 312 | Y → C |
| | | 324 | C → T |
| | | 343 | T → C |
| | | 345 | T → C |
| | | 358 | C → T |
| | | 377 | A → T |
| | | 381 | G → A |
| | | 385 | G → A |
| | | 387 | A → C |
| | | 404 | W → T |
| QTL6SNP13 | 24 | 358 | A → T |
| | | 359 | G → A |
| | | 371 | insertion of two nucleotides (AG) |
| | | 421 | G → T |
| | | 422 | A → C |
| | | 423 | deletion of T |
| | | 425 | C → A |
| | | 426 | A → G |
| QTL6SNP14 | 26 | 28 | C → T |
| | | 31 | G → C |
| | | 35 | C → T |
| | | 43 | A → T |
| | | 50 | deletion of C |
| | | 111 | G → C |
| | | 117 | G → T |
| | | 143 | A → G |
| | | 192 | C → T |
| | | 197 | T → C |
| | | 219 | C → A |
| | | 266 | A → T |
| QTL6SNP15 | 28 | 41 | T → G |
| | | 62 | C → G |
| | | 92 | C → T |
| | | 158 | C → T |
| | | 182 | T → C |
| | | 194 | T → G |
| | | 200 | G → C |
| | | 226 | C → T |
| | | 229 | C → T |
| | | 349 | A → C |
| QTL6SNP16 | 30 | 102 | T → C |
| | | 145 | C → A |
| | | 162 | C → T |
| | | 165 | A → T |
| | | 198 | R → G |
| | | 199 | M → G |
| | | 221 | C → T |
| | | 247 | G → A |
| | | 251 | C → T |
| | | 253 | G → T |
| | | 306 | Y → T |
| | | 331 | M → C |
| | | 352 | T → C |
| | | 451 | T → C |
| | | 461 | C → T |
| | | 464 | S → C |
| QTL6SNP17 | 32 | 61 | T → C |
| | | 73 | T → C |
| | | 87 | C → T |
| | | 143 | insertion of 5 nucleotides (AGCTA) |
| | | 199 | C → G |
| | | 208 | deletion of C |
| | | 209 | deletion of A |
| | | 210 | deletion of T |
| | | 211 | deletion of G |
| | | 225 | A → C |
| | | 327 | deletion of T |
| | | 328 | deletion of C |
| | | 335 | insertion of T |
| MZA5002 | 34 | 60 | G → C |
| | | 63 | C → G |
| | | 138 | G → C |
| | | 192 | G → C |
| | | 315 | C → G |
| | | 353 | deletion of C |
| | | 354 | deletion of G |
| | | 355 | deletion of G |
| | | 356 | deletion of C |
| | | 357 | deletion of G |
| | | 358 | deletion of G |
| | | 359 | deletion of C |
| | | 360 | deletion of C |
| | | 361 | deletion of G |
| | | 377 | A → C |
| | | 378 | G → C |
| | | 383 | C → A |
| | | 386 | A → C |
| | | 387 | G → C |
| | | 389 | A → C |
| | | 427 | T → A |
| | | 428 | C → G |
| | | 430 | G → T |
| | | 431 | G → T |
| | | 433 | deletion of G |
| | | 434 | deletion of C |
| | | 522 | T → C |
| MZA13321 | 36 | 17 | A → C |
| | | 25 | Y → C |
| | | 32 | Y → C |
| | | 110 | G → C |
| MZA15785 | 38 | 326 | G → A |
| | | 402 | T → A |
| MZA13118 | 40 | 34 | A → C |
| | | 169 | A → G |
| MZA11771 | 42 | 164 | T → C |
| | | 268 | G → A |
| | | 435 | T → G |
| MZA9351 | 44 | 17 | T → A |
| | | 21 | G → A |
| | | 23 | G → T |
| | | 54 | T → C |
| | | 134 | T → C |
| | | 137 | C → T |
| MZA8135 | 46 | 54 | C → A |
| | | 60 | insertion of A |
| | | 64 | G → T |
| | | 87 | C → G |
| | | 94 | T → C |
| | | 95 | A → C |
| | | 126 | C → T |
| | | 161 | G → A |
| | | 163 | C → T |
| | | 234 | C → T |

TABLE 2-continued

Location of polymorphisms within marker loci of the maize QTL6 region.

| Marker Locus | SEQ ID NO: | NT | Polymorphic Change |
|---|---|---|---|
| | | 237 | T → C |
| | | 297 | A → G |
| | | 319 | T → A |
| | | 320 | deletion of T |
| | | 321 | deletion of T |
| | | 323 | A → C |
| | | 394 | insertion of 2 nucleotides (TA) |
| | | 395 | A → T |
| | | 468 | insertion of 2 nucleotides (TC) |
| ZmDGAT1-2 | 51 | 134 | T → G |
| | | 163 | C → T |
| | | 190, 193, 196, or 199 | deletion of C |
| | | 191, 194, 197, or 200 | deletion of A |
| | | 192, 195, 198, or 201 | deletion of G |
| | | 1401, 1404, or 1407 | insertion of 3 nucleotides (TTC) immediately following this nucleotide position |

The sequence identifier refers to the specific marker locus sequence for EF09B (normal oil maize inbred line).
NT, the nucleotide position within the sequence identifier for EF09B where a polymorphism has been identified in the corresponding marker locus for ASK (high oil, high oleic acid maize inbred line);
"polymorphic change" refers to the specific substitution, insertion, or deletion occurring within the corresponding marker locus for ASK.

Suitable primers for detecting the presence of these marker loci in a plant or plant tissue are set forth in FIGS. 7-29 and SEQ ID NOs:68-115, and 124-127.

Example 3

Marker-Assisted Breeding for QTL6

This example sets forth the use of the polymorphisms in the various molecular markers of QTL6 to accelerate incorporation of the high oil and/or high oleic acid trait into other maize germplasm with the result of increasing oil and/or oleic acid in the embryo and kernel.

The present invention provides a maize plant with increased embryo and/or kernel oil and/or oleic acid content selected for with the use of marker-assisted breeding wherein a population of plants are selected for the presence of at least one of the polymorphic sequences set forth in Example 2, Table 2. The selection of plants having at least one of the polymorphic sequences associated with the high oil and/or high oleic acid trait comprises probing genomic DNA of the resulting plant, through the selection process, for the presence of the polymorphism. The plants containing the desired marker locus are continued in the breeding and selection process.

Further, because oleic acid concentration shows a larger increase than oil content within plants carrying the favorable high-oil/high oleic-acid QTL6 marker locus and can be measured with accuracy, it can be used to monitor and confirm the presence of QTL6 during the marker-assisted breeding process. Thus, for example, any given maize plant or the resultant progeny from crosses or backcrosses between maize plants can be screened for the presence of the QTL6 marker locus by examining their oleic acid content, particularly within the whole kernel or embryo. In this manner, a seed or embryo oleic acid concentration of at least 35% (i.e., 35% or more of the seed or embryo oil is represented by oleic acid) would be predictive that the plant likely comprises the desired QTL6 marker locus, and thus could be beneficially continued in the breeding and selection process. Alternatively, a seed or embryo oleic acid concentration of less than 35% (i.e., oleic acid represents less than 35% of the seed or embryo oil) would be predictive that the plant source does not carry the desired QTL6 locus within its genome.

This oleic acid screening step could be further supplemented with genomic screens for the presence of the QTL6 locus. In one such example, the presence of the desired QTL6 locus is confirmed by detecting the presence of the TTC codon insertion within the ZmDGAT1-2 coding sequence that results in the $Phe_{467}$, $Phe_{468}$, or $Phe_{469}$ insertion within the ZmDGAT1-2(ASK) protein. This can be achieved, for example, by amplification of a DNA fragment around this codon using SEQ ID NOs:126 and 127, as described in Example 13 herein below.

Example 4

Sequence Characterization of Open Reading Frames in QTL6

A. DGAT

FIG. 31 shows the nucleic acid sequence alignment of the high oil/high oleic acid variant of ZmDGAT1-2 (derived from ASK inbred line; SEQ ID NO:48, encoded by SEQ ID NO:47) compared to the ZmDGAT1-2 sequence obtained from normal oil maize inbred lines Mo17 (SEQ ID NO:50, encoded by SEQ ID NO:49), EFO9B (SEQ ID NO:52, encoded by SEQ ID NO:51), and B73 (SEQ ID NO:54, encoded by SEQ ID NO:53). The alignment of the respective amino acid sequences for these proteins is shown in FIG. 30. The nucleic acid sequence alignment shows that there are the following polymorphisms unique to the high oil/high oleic acid allele of ZmDGAT1-2 that are not found in the corresponding sequence from the normal oil maize inbred lines. Table 3 below summarizes the polymorphisms identified in the high oil/high oleic variant of ZmDGAT1-2 (i.e., ZmDGAT1-2(ASK)) that lead to residue changes within ZmDGAT1-2(ASK).

As can be seen from the alignment of the ZmDGAT1-2 (ASK) protein with that of the DGAT1-2 protein from the normal oil maize inbred lines (i.e., EF09B, Mo17, and B73), the ZmDGAT1-2(ASK) protein has a glutamine deletion and phenylalanine insertion relative to the normal oil DGAT1-2 protein. Note that because the glutamine deletion and phenylalanine insertion shown in FIG. 30 occur within regions of the DGAT1-2 protein that comprise repeating glutamine and repeating phenylalanine residues, respectively, the deletion and insertion could occur at any one of the respective repeating residues. Thus, although the glutamine deletion shown in FIG. 30 appears at the position corresponding to $Gln_{67}$ of the normal oil DGAT1-2 protein, in actuality, the glutamine deletion could represent a deletion of the residue corresponding to $Gln_{64}$, $Gln_{65}$, $Gln_{66}$, or $Gln_{67}$ of the normal oil DGAT1-2 (e.g., EF09B of SEQ ID NO:52). Similarly, although the phenylalanine insertion within DGAT1-2(ASK) shown in FIG. 30 is represented by $Phe_{469}$ of this protein, in actuality, the phenylalanine insertion relative to normal oil DGAT-12 could be represented by the phenylalanine at position 467, 468, or 469 of DGAT1-2(ASK) (see SEQ ID NO:48).

TABLE 3

Location of polymorphisms within ZmDGAT1-2 ORF of the maize QTL6 region. The sequence identifier refers to the ZmDGAT1-2 ORF for EF09B (normal oil maize inbred line; SEQ ID NO:51). NT, the nucleotide position within the sequence identifier for EF09B where a polymorphism has been identified in the corresponding ZmDGAT1-2 ORF for ASK (high oil, high oleic acid maize inbred line); "polymorphic change" refers to the specific substitution, insertion, or deletion occurring within the corresponding ZmDGAT1-2 ORF for ASK (SEQ ID NO:47); "residue change" refers to the amino acid substitution, deletion, or insertion within the corresponding ZmDGAT1-2 protein for ASK (SEQ ID NO:48) as compared to the EF09B reference sequence (SEQ ID NO:52) as a result of the polymorphic change within the ZmDGAT1-2 ORF for ASK (SEQ ID NO:47).

| ORF | SEQ ID NO | NT | Polymorphic Change | Residue Change |
|---|---|---|---|---|
| ZmDGAT1-2 | 51 | 134 | T →G | $Val_{45}$ →$Gly_{45}$ |
|  |  | 163 | C →T | $Pro_{55}$ →$Ser_{55}$ |
|  |  | 190-192 | deletion of CAG | deletion of $Gln_{64}$* |
|  |  | or |  | or |
|  |  | 193-195 |  | deletion of $Gln_{65}$ |
|  |  | or |  | or |
|  |  | 196-198 |  | deletion of $Gln_{66}$ |
|  |  | or |  | or |
|  |  | 199-201 |  | deletion of $Gln_{67}$ |
|  |  | 1401 | insertion of TTC immediately following this nucleotide position | insertion of → $Phe_{467}$** |
|  |  | or |  |  |
|  |  | 1404 |  | insertion of → $Phe_{468}$ |
|  |  | or |  |  |
|  |  | 1407 |  | insertion of → $Phe_{469}$ |

*ZmDGAT 1-2 protein for ASK (SEQ ID NO:48) is missing the glutamine residue corresponding to that at position 64, 65, 66, or 67 of the ZmDGAT1-2 protein for EF09B (SEQ ID NO:52), depending upon whether the deletion of the three nucleotides CAG within the corresponding coding sequence for the ZmDGAT1-2 protein for EF09B (SEQ ID NO:51) occurs at nucleotides 190-192, 193-195, 196-198, or 199-201.
**The phenylalanine residue at position 467, 468, or 469 of ZmDGAT1-2 protein for ASK (SEQ ID NO:48) represents an insertion within this protein relative to the corresponding location within the ZmDGAT1-2 protein for EF09B (SEQ ID NO:52). Thus $Phe_{467}$ within the ASK sequence would correspond to an insertion of this residue between $Trp_{467}$ and $Phe_{468}$ of the ZmDGAT 1-2 protein for EF09B (SEQ ID NO:52). $Phe_{468}$ of the ASK sequence would correspond to an insertion of this residue between $Phe_{468}$ and $Phe_{469}$ of the ZmDGAT1-2 protein for EF09B. $Phe_{469}$ of the ASK sequence would correspond to an insertion of this residue between $Phe_{469}$ and $Ser_{470}$ of the ZmDGAT1-2 protein for EF09B. The location of the phenylalanine residue insertion within the ASK sequence would depend upon whether the polymorphic change observed in the ASK coding sequence (i.e., the TTC insertion) occurs at the position corresponding to nt 1401, 1404, or 1407 or the coding sequence for the normal oil EF09B ZmDGAT1-2 protein (i.e., SEQ ID NO:51).

These polymorphisms within the ZmDGAT1-2 ORF for ASK can be characterized by the residue change occurring within the encoded ZmDGAT1-2 protein for ASK (SEQ ID NO:48) with respect to the corresponding residue for the ZmDGAT1-2 protein for EF09B (SEQ ID NO:52) as follows:

1. Single Nucleotide Polymorphisms a. valine at position 45 of SEQ ID NO:52 is substituted with a glycine at position 45 of SEQ ID NO:48 b. proline at position 55 of SEQ ID NO:52 is substituted with a serine at position 55 of SEQ ID NO:48

2. Deletions

The glutamine residue corresponding to the glutamine residue at amino acid position 64, 65, 66, or 67 of SEQ ID NO:52 is deleted within SEQ ID NO:48.

3. Insertions

The ZmDGAT1-2(ASK) protein has an insertion of a phenylalanine residue at a position located between a pair of residues corresponding to a pair of residues within SEQ ID NO:52 selected from:

a. the tryptophan residue at amino acid position 467 of SEQ ID NO:52 and the phenylalanine residue at amino acid position 468 of SEQ ID NO:52; or b. the phenylalanine residue at amino acid position 468 of SEQ ID NO: 52 and the phenylalanine residue at amino acid position 469 of SEQ ID NO:52; or c. the phenylalanine residue at amino acid position 469 of SEQ ID NO:52 and the serine residue at amino acid position 470 of SEQ ID NO:52.

The ZmDGAT1-2(ASK) protein (SEQ ID NO:48) comprises all four of these residue changes. The polymorphism(s) unique to the ZmDGAT1-2 ORF (SEQ ID NO:47, encoding the ZmDGAT1-2(ASK) polypeptide in SEQ ID NO:48) from the ASK high oil, high oleic acid inbred line can also be used in marker-assisted selection and breeding as described in Example 5 below.

B. Amino Acid Permease 1 (AAP1)

The present invention also provides the open reading frame for the maize amino acid permease 1 (AAP1) polypeptide (SEQ ID NO:56; designated ZmAAP1) and biologically active variants thereof as defined herein below. Isolated polynucleotides encoding the ZmAAP1 polypeptide are also encompassed by the present invention. In one such embodiment, the isolated polynucleotide comprises the sequence set forth in SEQ ID NO:55 or variant thereof encoding a biologically active AAP1 polypeptide. FIG. 34 shows an alignment of the ZmAAP1 polypeptide with other related AAP polypeptides from other plant species.

C. K+ Efflux System Protein (PESP)

The present invention also provides the open reading frame for the maize potassium efflux system protein (SEQ ID NO:58; designated ZmPESP) and biologically active variants thereof as defined herein below. Isolated polynucleotides encoding the ZmPESP polypeptide are also encompassed by the present invention. In one such embodiment, the isolated polynucleotide comprises the sequence set forth in SEQ ID NO:57 or variant thereof encoding a biologically active PESP polypeptide. FIG. 35 shows an alignment of the ZmPESP polypeptide with other related PESP polypeptides from other plant species.

D. 40S Ribosomal Protein S24

The present invention also provides the open reading frame for the maize 40S ribosomal protein S24 (SEQ ID NO:60; designated ZmS24) and biologically active variants thereof as defined herein below. Isolated polynucleotides encoding the ZmS24 polypeptide are also encompassed by the present invention. In one such embodiment, the isolated polynucleotide comprises the sequence set forth in SEQ ID NO:59 or variant thereof encoding a biologically active 40S ribosomal protein S24. FIG. 36 shows an alignment of the ZmS24 polypeptide with other related ribosomal proteins from other plant species.

E. ABC Transporter

The present invention also provides the open reading frame for a maize PDR-like ABC transporter (ABCT) polypeptide (composite sequence shown in SEQ ID NO:64; designated ZmABCT (Composite) herein) and biologically active variants thereof as defined herein below. Isolated polynucleotides encoding the ZmABCT (Composite) polypeptide are also encompassed by the present invention. In one such embodiment, the isolated polynucleotide comprises the sequence set forth in SEQ ID NO:63 or variant thereof encoding a biologically active AAP1 polypeptide.

The full-length coding sequence was constructed from the ZmABCT partial ORF cDNA sequence cloned from the normal oil Mo17 inbred maize line (sequence set forth in SEQ ID NO:61, encoding the N-terminal amino acid sequence set forth in SEQ ID NO:62) and the EST and genomic sequence for the normal oil B73 inbred maize line. FIG. 37 shows an alignment of the ZmABCT (Composite) polypeptide with other related ABCT polypeptides from other plant species.

Example 5

Marker-Assisted Breeding for QTL6

This example sets forth the use of the polymorphisms in the high oil/high oleic acid variant of DGAT, for example, ZmD-GAT1-2(ASK) of SEQ ID NO:47, as molecular markers to accelerate incorporation of the high oil and/or high oleic acid trait into other corn germplasm with the result of increasing oil and/or oleic in the kernel, and/or increasing the oleic acid/linoleic acid ratio in the kernel.

The present invention provides a corn plant with increased kernel oil and/or oleic acid content selected for by use of marker-assisted breeding wherein a population of plants is selected for the presence of at least one of the polymorphic sequences unique to the high oil/high oleic acid variant of DGAT. Example 4, Table 3, above, lists the polymorphisms unique to the high oil/high oleic DGAT.

The selection of plants having at least one of the polymorphic sequences of the high oil/high oleic acid variant of DGAT, which is associated with the high oil and/or high oleic trait, comprises probing genomic DNA of the resulting plant, through the selection process, for the presence of the polymorphism. Suitable primers for detecting the presence of the high/oil/high oleic acid variant are set forth in SEQ ID NOS: 114, 115, and 124-127. For example, the primer pair set forth as SEQ ID NOS:124 and 125 will amplify a fragment that encompasses the first three changes in the N-terminus of the DGAT1-2 ASK protein (nt 134, 163, 199-201 in Table 3 above). The primer pair set forth as SEQ ID NOS:126 and 127 will amplify a fragment that includes the change in the C-terminus of DGAT1-2 ASK (nt 1408-1410 in Table 3 above). The plants containing the high oil/high oleic acid DGAT are continued in the breeding and selection process.

Example 6

Transformation and Regeneration of Transgenic Maize Plants

Immature maize embryos from greenhouse donor plants are bombarded with a plasmid containing the ZmDGAT1-2 (ASK) sequence of SEQ ID NO:47, or the ZmDGAT1-2 (EF09B) sequence of SEQ ID NO:51, operably linked to a promoter of interest and the selectable marker gene PAT (Wohlleben et al. (1988) *Gene* 70:25-37), which confers resistance to the herbicide Bialaphos. Alternatively, the selectable marker gene is provided on a separate plasmid. Transformation is performed as follows. Media recipes follow below.

Preparation of Target Tissue

The ears are husked and surface sterilized in 30% Clorox bleach plus 0.5% Micro detergent for 20 minutes, and rinsed two times with sterile water. The immature embryos are excised and placed embryo axis side down (scutellum side up), 25 embryos per plate, on 560Y medium for 4 hours and then aligned within the 2.5 cm target zone in preparation for bombardment.

A plasmid vector comprising the ZmDGAT1-2(ASK) sequence of SEQ ID NO:47, or the ZmDGAT1-2(EF09B) sequence of SEQ ID NO:51, operably linked to a promoter of interest is made. This plasmid DNA plus plasmid DNA containing a PAT selectable marker is precipitated onto 1.1 µm (average diameter) tungsten pellets using a $CaCl_2$ precipitation procedure as follows: 100 µl prepared tungsten particles in water; 10 µl (1 µg) DNA in Tris EDTA buffer (1 µg total DNA); 100 µl 2.5 M $CaCl_2$; and, 10 µl 0.1 M spermidine.

Each reagent is added sequentially to the tungsten particle suspension, while maintained on the multitube vortexer. The final mixture is sonicated briefly and allowed to incubate under constant vortexing for 10 minutes. After the precipitation period, the tubes are centrifuged briefly, liquid removed, washed with 500 ml 100% ethanol, and centrifuged for 30 seconds. Again the liquid is removed, and 105 µl 100% ethanol is added to the final tungsten particle pellet. For particle gun bombardment, the tungsten/DNA particles are briefly sonicated and 10 µl spotted onto the center of each macrocarrier and allowed to dry about 2 minutes before bombardment.

The sample plates are bombarded at level #4 in a particle gun. All samples receive a single shot at 650 PSI, with a total of ten aliquots taken from each tube of prepared particles/DNA.

Following bombardment, the embryos are kept on 560Y medium for 2 days, then transferred to 560R selection medium containing 3 mg/liter Bialaphos, and subcultured every 2 weeks. After approximately 10 weeks of selection, selection-resistant callus clones are transferred to 288J medium to initiate plant regeneration. Following somatic embryo maturation (2-4 weeks), well-developed somatic embryos are transferred to medium for germination and transferred to the lighted culture room. Approximately 7-10 days later, developing plantlets are transferred to 272V hormone-free medium in tubes for 7-10 days until plantlets are well established. Plants are then transferred to inserts in flats (equivalent to 2.5" pot) containing potting soil and grown for 1 week in a growth chamber, subsequently grown an additional 1-2 weeks in the greenhouse, then transferred to classic 600 pots (1.6 gallon) and grown to maturity. Plants are monitored and scored for oil content and oleic acid content.

Bombardment medium (560Y) comprises 4.0 g/l N6 basal salts (SIGMA C-1416), 1.0 ml/l Eriksson's Vitamin Mix (1000×SIGMA-1511), 0.5 mg/l thiamine HCl, 120.0 g/l sucrose, 1.0 mg/l 2,4-D, and 2.88 g/l L-proline (brought to volume with D-I $H_2O$ following adjustment to pH 5.8 with KOH); 2.0 g/l Gelrite (added after bringing to volume with D-I $H_2O$); and 8.5 mg/l silver nitrate (added after sterilizing the medium and cooling to room temperature). Selection medium (560R) comprises 4.0 g/l N6 basal salts (SIGMA C-1416), 1.0 ml/l Eriksson's Vitamin Mix (1000×SIGMA-1511), 0.5 mg/l thiamine HCl, 30.0 g/l sucrose, and 2.0 mg/l 2,4-D (brought to volume with D-I $H_2O$ following adjustment to pH 5.8 with KOH); 3.0 g/l Gelrite (added after bringing to volume with D-I $H_2O$); and 0.85 mg/l silver nitrate and 3.0 mg/l bialaphos (both added after sterilizing the medium and cooling to room temperature).

Plant regeneration medium (288J) comprises 4.3 g/l MS salts (GIBCO 11117-074), 5.0 ml/l MS vitamins stock solution (0.100 g nicotinic acid, 0.02 g/l thiamine HCL, 0.10 g/l pyridoxine HCL, and 0.40 g/l glycine brought to volume with polished D-I $H_2O$) (Murashige and Skoog (1962) *Physiol. Plant.* 15:473), 100 mg/l myo-inositol, 0.5 mg/l zeatin, 60 g/l sucrose, and 1.0 ml/l of 0.1 mM abscisic acid (brought to volume with polished D-I $H_2O$ after adjusting to pH 5.6); 3.0 g/l Gelrite (added after bringing to volume with D-I $H_2O$); and 1.0 mg/l indoleacetic acid and 3.0 mg/l bialaphos (added after sterilizing the medium and cooling to 60° C.). Hormone-free medium (272V) comprises 4.3 g/l MS salts (GIBCO 11117-074), 5.0 ml/l MS vitamins stock solution (0.100 g/l nicotinic acid, 0.02 g/l thiamine HCL, 0.10 g/l pyridoxine HCL, and 0.40 g/l glycine brought to volume with polished D-I H$_2$O), 0.1 g/l myo-inositol, and 40.0 g/l sucrose (brought to volume with polished D-I H$_2$O after adjusting pH to 5.6); and 6 g/l bacto-agar (added after bringing to volume with polished D-I H$_2$O), sterilized and cooled to 60° C.

Example 7

*Agrobacterium*-Mediated Transformation of Maize

For *Agrobacterium*-mediated transformation of maize with a ZmDGAT1-2(ASK) sequence of SEQ ID NO:47, or a ZmDGAT1-2(EF09B) sequence of SEQ ID NO:51, the method of Zhao is employed (U.S. Pat. No. 5,981,840, and PCT patent publication WO98/32326; the contents of which are hereby incorporated by reference). Briefly, immature embryos are isolated from maize and the embryos contacted with a suspension of *Agrobacterium*, where the bacteria are capable of transferring the ZmDGAT1-2(ASK) sequence of SEQ ID NO:47, or ZmDGAT1-2(EF09B) sequence of SEQ ID NO:51, operably linked to a promoter of interest to at least one cell of at least one of the immature embryos (step 1: the infection step). In this step the immature embryos are immersed in an *Agrobacterium* suspension for the initiation of inoculation. The embryos are co-cultured for a time with the *Agrobacterium* (step 2: the co-cultivation step). The immature embryos are cultured on solid medium following the infection step. Following this co-cultivation period an optional "resting" step is contemplated. In this resting step, the embryos are incubated in the presence of at least one antibiotic known to inhibit the growth of *Agrobacterium* without the addition of a selective agent for plant transformants (step 3: resting step). The immature embryos are cultured on solid medium with antibiotic, but without a selecting agent, for elimination of *Agrobacterium* and for a resting phase for the infected cells. Next, inoculated embryos are cultured on medium containing a selective agent and growing transformed callus is recovered (step 4: the selection step). The immature embryos are cultured on solid medium with a selective agent resulting in the selective growth of transformed cells. The callus is then regenerated into plants (step 5: the regeneration step), and calli grown on selective medium are cultured on solid medium to regenerate the plants.

Example 8

Soybean Embryo Transformation

A. Culture Conditions

Soybean embryogenic suspension cultures (cv. Jack) are maintained in 35 ml liquid medium SB196 (see recipes below) on rotary shaker, 150 rpm, 26° C. with cool white fluorescent lights on 16:8 hr day/night photoperiod at light intensity of 60-85 µE/m2/s. Cultures are subcultured every 7 days to two weeks by inoculating approximately 35 mg of tissue into 35 ml of fresh liquid SB196 (the preferred subculture interval is every 7 days).

Soybean embryogenic suspension cultures are transformed with the plasmids and DNA fragments described in the following examples by the method of particle gun bombardment (Klein et al. (1987) *Nature*, 327:70).

B. Soybean Embryogenic Suspension Culture Initiation

Soybean cultures are initiated twice each month with 5-7 days between each initiation.

Pods with immature seeds from available soybean plants 45-55 days after planting are picked, removed from their shells and placed into a sterilized magenta box. The soybean seeds are sterilized by shaking them for 15 minutes in a 5% Clorox solution with 1 drop of ivory soap (95 ml of autoclaved distilled water plus 5 ml Clorox and 1 drop of soap). Mix well. Seeds are rinsed using 2 1-liter bottles of sterile distilled water and those less than 4 mm are placed on individual microscope slides. The small end of the seed are cut and the cotyledons pressed out of the seed coat. Cotyledons are transferred to plates containing SB1 medium (25-30 cotyledons per plate). Plates are wrapped with fiber tape and stored for 8 weeks. After this time secondary embryos are cut and placed into SB196 liquid media for 7 days.

C. Preparation of DNA for Bombardment

Either an intact plasmid or a DNA plasmid fragment containing the genes of interest and the selectable marker gene are used for bombardment. Plasmid DNA for bombardment are routinely prepared and purified using the method described in the Promega™ Protocols and Applications Guide, Second Edition (page 106). Fragments of the plasmids carrying the ZmDGAT1-2(ASK) sequence of SEQ ID NO:47, or ZmDGAT1-2(EF09B) sequence of SEQ ID NO:51, operably linked to a promoter of interest are obtained by gel isolation of double digested plasmids. In each case, 100 ug of plasmid DNA is digested in 0.5 ml of the specific enzyme mix that is appropriate for the plasmid of interest. The resulting DNA fragments are separated by gel electrophoresis on 1% SeaPlaque GTG agarose (BioWhitaker Molecular Applications) and the DNA fragments containing ZmDGAT1-2(ASK) sequence of SEQ ID NO:47, or ZmDGAT1-2(EF09B) sequence of SEQ ID NO:51, operably linked to a promoter of interest are cut from the agarose gel. DNA is purified from the agarose using the GELase digesting enzyme following the manufacturer's protocol.

A 50 µl aliquot of sterile distilled water containing 3 mg of gold particles (3 mg gold) is added to 5 µl of a 1 µg/µl DNA solution (either intact plasmid or DNA fragment prepared as described above), 50 µl 2.5M CaCl$_2$ and 20 µl of 0.1 M spermidine. The mixture is shaken 3 min on level 3 of a vortex shaker and spun for 10 sec in a bench microfuge. After a wash with 400 µl 100% ethanol the pellet is suspended by sonication in 40 µl of 100% ethanol. Five µl of DNA suspension is dispensed to each flying disk of the Biolistic PDS1000/HE instrument disk. Each 5 µl aliquot contains approximately 0.375 mg gold per bombardment (i.e. per disk).

D. Tissue Preparation and Bombardment with DNA

Approximately 150-200 mg of 7 day old embryonic suspension cultures are placed in an empty, sterile 60×15 mm petri dish and the dish covered with plastic mesh. Tissue is bombarded 1 or 2 shots per plate with membrane rupture pressure set at 1100 PSI and the chamber evacuated to a vacuum of 27-28 inches of mercury. Tissue is placed approximately 3.5 inches from the retaining/stopping screen.

E. Selection of Transformed Embryos

Transformed embryos are selected either using hygromycin (when the hygromycin phosphotransferase, HPT, gene is used as the selectable marker) or chlorsulfuron (when the acetolactate synthase, ALS, gene is used as the selectable marker).

F. Hygromycin (HPT) Selection

Following bombardment, the tissue is placed into fresh SB196 media and cultured as described above. Six days post-bombardment, the SB196 is exchanged with fresh SB196 containing a selection agent of 30 mg/L hygromycin. The selection media is refreshed weekly. Four to six weeks post selection, green, transformed tissue may be observed growing from untransformed, necrotic embryogenic clusters. Isolated, green tissue is removed and inoculated into multiwell plates to generate new, clonally propagated, transformed embryogenic suspension cultures.

G. Chlorsulfuron (ALS) Selection

Following bombardment, the tissue is divided between 2 flasks with fresh SB196 media and cultured as described above. Six to seven days post-bombardment, the SB196 is exchanged with fresh SB196 containing selection agent of 100 ng/ml Chlorsulfuron. The selection media is refreshed weekly. Four to six weeks post selection, green, transformed tissue may be observed growing from untransformed, necrotic embryogenic clusters. Isolated, green tissue is removed and inoculated into multiwell plates containing SB196 to generate new, clonally propagated, transformed embryogenic suspension cultures.

H. Regeneration of Soybean Somatic Embryos into Plants

In order to obtain whole plants from embryogenic suspension cultures, the tissue must be regenerated.

I. Embryo Maturation

Embryos are cultured for 4-6 weeks at 26° C. in SB196 under cool white fluorescent (Phillips cool white Econowatt F40/CW/RS/EW) and Agro (Phillips F40 Agro) bulbs (40 watt) on a 16:8 hr photoperiod with light intensity of 90-120 uE/m2s. After this time embryo clusters are removed to a solid agar media, SB166, for 1-2 weeks. Clusters are then subcultured to medium SB103 for 3 weeks. During this period, individual embryos can be removed from the clusters and screened for the high oil/high oleic acid phenotype associated with the presence of ZmDGAT1-2(ASK), or increased oil content, and/or increased oleic acid content, and/or increased oleic acid/linoleic acid ratio due to overexpression of normal oil ZmDGAT1-2(EF09B). It should be noted that any detectable phenotype, resulting from the expression of the genes of interest, could be screened at this stage.

J. Embryo Desiccation and Germination

Matured individual embryos are desiccated by placing them into an empty, small petri dish (35×10 mm) for approximately 4-7 days. The plates are sealed with fiber tape (creating a small humidity chamber). Desiccated embryos are planted into SB71-4 medium where they were left to germinate under the same culture conditions described above. Germinated plantlets are removed from germination medium and rinsed thoroughly with water and then planted in Redi-Earth in 24-cell pack tray, covered with clear plastic dome. After 2 weeks the dome is removed and plants hardened off for a further week. If plantlets looked hardy they are transplanted to 10" pot of Redi-Earth with up to 3 plantlets per pot. After 10 to 16 weeks, mature seeds are harvested, chipped and analyzed for proteins.

K. Media Recipes

| 1. SB 196-FN Lite liquid proliferation medium (per liter)- | |
|---|---|
| MS FeEDTA-100x Stock 1 | 10 ml |
| MS Sulfate-100x Stock 2 | 10 ml |
| FN Lite Halides-100x Stock 3 | 10 ml |
| FN Lite P,B,Mo-100x Stock 4 | 10 ml |
| B5 vitamins (1 ml/L) | 1.0 ml |
| 2,4-D (10 mg/L final concentration) | 1.0 ml |
| KNO3 | 2.83 gm |
| (NH4)2 SO 4 | 0.463 gm |
| Asparagine | 1.0 gm |
| Sucrose (1%) | 10 gm |
| pH 5.8 | |

| -continued | | |
|---|---|---|
| FN Lite Stock Solutions | | |
| Stock # | 1000 ml | 500 ml1 |
| MS Fe EDTA 100× Stock | | |
| Na$_2$ EDTA* | 3.724 g | 1.862 g |
| FeSO$_4$—7H$_2$O | 2.784 g | 1.392 g |
| 2MS Sulfate 100× stock | | |
| MgSO$_4$—7H$_2$O | 37.0 g | 18.5 g |
| MnSO$_4$—H$_2$O | 1.69 g | 0.845 g |
| ZnSO$_4$—7H$_2$O | 0.86 g | 0.43 g |
| CuSO$_4$—5H$_2$O | 0.0025 g | 0.00125 g |
| FN Lite Halides 100× Stock | | |
| CaCl$_2$—2H$_2$O | 30.0 g | 15.0 g |
| KI | 0.083 g | 0.0715 g |
| CoCl$_2$—6H$_2$O | 0.0025 g | 0.00125 g |
| FN Lite P,B,Mo 100× Stock | | |
| KH$_2$PO$_4$ | 18.5 g | 9.25 g |
| H$_3$BO$_3$ | 0.62 g | 0.31 g |
| Na$_2$MoO$_4$—2H$_2$O | 0.025 g | 0.0125 g |

*Add first, dissolve in dark bottle while stirring

SB1 solid medium (per liter) comprises: 1 pkg. MS salts (Gibco/BRL—Cat# 11117-066); 1 ml B5 vitamins 1000× stock; 31.5 g sucrose; 2 ml 2,4-D (20 mg/L final concentration); pH 5.7; and, 8 g TC agar.

SB 166 solid medium (per liter) comprises: 1 pkg. MS salts (Gibco/BRL—Cat# 11117-066); 1 ml B5 vitamins 1000× stock; 60 g maltose; 750 mg MgCl$_2$ hexahydrate; 5 g activated charcoal; pH 5.7; and, 2 g gelrite.

SB 103 solid medium (per liter) comprises: 1 pkg. MS salts (Gibco/BRL—Cat# 11117-066); 1 ml B5 vitamins 1000× stock; 60 g maltose; 750 mg MgCl$_2$ hexahydrate; pH 5.7; and, 2 g gelrite.

SB 71-4 solid medium (per liter) comprises: 1 bottle Gamborg's B5 salts w/sucrose (Gibco/BRL—Cat# 2115 3-036); pH 5.7; and, 5 g TC agar.

2,4-D stock is obtained premade from Phytotech cat# D 295—concentration is 1 mg/ml.

B5 Vitamins Stock (per 100 ml) which is stored in aliquots at −20 C comprises: 10 g myo-inositol; 100 mg nicotinic acid; 100 mg pyridoxine HCl; and, 1 g thiamine. If the solution does not dissolve quickly enough, apply a low level of heat via the hot stir plate. Chlorsulfuron Stock comprises 1 mg/ml in 0.01 N Ammonium Hydroxide Example 9

Sequence Identifiers

Table 4 provides a summary of the sequence identifiers for the marker loci and associated sequences referred to herein.

TABLE 4

Summary of Sequence Identifiers.

| SEQ ID NO | Description |
|---|---|
| 1 | Marker sequence for BAC05-ASK |
| 2 | Marker sequence for BAC05-EF09B |
| 3 | Marker sequence for BAC17-ASK |
| 4 | Marker sequence for BAC17-EF09B |
| 5 | Marker sequence for BAC18-ASK |
| 6 | Marker sequence for BAC18-EF09B |
| 7 | Marker sequence for BAC20-ASK |

TABLE 4-continued

Summary of Sequence Identifiers.

| SEQ ID NO | Description |
|---|---|
| 8 | Marker sequence for BAC20-EF09B |
| 9 | Marker sequence for BAC22-ASK |
| 10 | Marker sequence for BAC22-EF09B |
| 11 | Marker sequence for BAC24-ASK |
| 12 | Marker sequence for BAC24-EF09B |
| 13 | Marker sequence for BAC29-ASK |
| 14 | Marker sequence for BAC29-EF09B |
| 15 | Marker sequence for BAC32-ASK |
| 16 | Marker sequence for BAC32-EF09B |
| 17 | Marker sequence for QTL6SNP7-ASK |
| 18 | Marker sequence for QTL6SNP7-EF09B |
| 19 | Marker sequence for QTL6SNP8-ASK |
| 20 | Marker sequence for QTL6SNP8-EF09B |
| 21 | Marker sequence for QTL6SNP9-ASK |
| 22 | Marker sequence for QTL6SNP9-EF09B |
| 23 | Marker sequence for QTL6SNP13-ASK |
| 24 | Marker sequence for QTL6SNP13-EF09B |
| 25 | Marker sequence for QTL6SNP14-ASK |
| 26 | Marker sequence for QTL6SNP14-EF09B |
| 27 | Marker sequence for QTL6SNP15-ASK |
| 28 | Marker sequence for QTL6SNP15-EF09B |
| 29 | Marker sequence for QTL6SNP16-ASK |
| 30 | Marker sequence for QTL6SNP16-EF09B |
| 31 | Marker sequence for QTL6SNP17-ASK |
| 32 | Marker sequence for QTL6SNP17-EF09B |
| 33 | Marker sequence for MZA5002-ASK |
| 34 | Marker sequence for MZA5002-EF09B |
| 35 | Marker sequence for MZA13321-ASK |
| 36 | Marker sequence for MZA13321-EF09B (partial) |
| 37 | Marker sequence for MZA15785-ASK |
| 38 | Marker sequence for MZA15785-EF09B |
| 39 | Marker sequence for MZA13118-ASK |
| 40 | Marker sequence for MZA13118-EF09B |
| 41 | Marker sequence for MZA11771-ASK |
| 42 | Marker sequence for MZA11771-EF09B |
| 43 | Marker sequence for MZA9351-ASK |
| 44 | Marker sequence for MZA9351-EF09B (partial) |
| 45 | Marker sequence for MZA8135-ASK |
| 46 | Marker sequence for MZA8135-EF09B |
| 47 | ZmDGAT1-2 cDNA ASK-nucleotide sequence |
| 48 | ZmDGAT1-2 ASK-amino acid sequence |
| 49 | ZmDGAT1-2 cDNA Mo17-nucleotide sequence |
| 50 | ZmDGAT1-2 Mo17-amino acid sequence |
| 51 | ZmDGAT1-2 cDNA EF09B-nucleotide sequence |
| 52 | ZmDGAT1-2 EF09B-amino acid sequence |
| 53 | ZmDGAT1-2 cDNA B73-nucleotide sequence |
| 54 | ZmDGAT1-2 B73-amino acid sequence |
| 55 | ZmAAP1 (Amino Acid Permease) (Mo17)-nucleotide sequence |
| 56 | ZmAAP1 (Amino Acid Permease) (Mo17)-amino acid sequence |
| 57 | ZmPESP (K+ efflux system protein) (Mo17)-nucleotide sequence |
| 58 | ZmPESP (K+ efflux system protein) (Mo17)-amino acid sequence |
| 59 | ZmS24 (40S Ribosomal Protein S24) (Mo17)-nucleotide sequence |
| 60 | ZmS24 (40S Ribosomal Protein S24) (Mo17)-amino acid sequence |
| 61 | ZmABCT (PDR-like ABC transporter) (Mo17)-5' end partial nucleotide sequence |
| 62 | ZmABCT (PDR-like ABC transporter) (Mo17)-N-term amino acid sequence |
| 63 | ZmABCT (PDR-like ABC transporter) composite from Mo17, B73 genomic and EST-nucleotide sequence |
| 64 | ZmABCT (PDR-like ABC transporter) composite from Mo17, B73 genomic and EST-amino acid sequence |
| 65 | Lec 1 con - amino acid |
| 66 | Lec 1 maize - nucleotide |
| 67 | Lec 1 maize - amino acid |
| 68 | BAC05 Forward primer (86488) |
| 69 | BAC05 Reverse primer (86489) |
| 70 | BAC17 Forward primer 86512 |
| 71 | BAC17 Reverse primer 86513 |
| 72 | BAC18 Forward primer (86514) |
| 73 | BAC18 Reverse primer (86515) |
| 74 | BAC20 Forward primer (86518) |
| 75 | BAC20 Reverse primer (86519) |
| 76 | BAC22 Forward primer (86522) |
| 77 | BAC22 Reverse primer (86523) |
| 78 | BAC24 Forward primer (86526) |
| 79 | BAC24 Reverse primer (86527) |
| 80 | BAC29 Forward primer (86536) |
| 81 | BAC29 Reverse primer (86537) |
| 82 | BAC32 Forward primer (86542) |
| 83 | BAC32 Reverse primer (86543) |
| 84 | QTL6SNP7 Forward primer (96066) |
| 85 | QTL6SNP7Reverse primer (96067) |
| 86 | QTL6SNP8 Forward primer (96068) |
| 87 | QTL6SNP8 Reverse primer (96069) |
| 88 | QTL6SNP9 Forward primer (96070) |
| 89 | QTL6SNP9 Reverse primer (96071) |
| 90 | QTL6SNP13 Forward primer (96080) |
| 91 | QTL6SNP13 Reverse primer (96081) |
| 92 | QTL6SNP14 Forward primer (96082) |
| 93 | QTL6SNP14 Reverse primer (96083) |
| 94 | QTL6SNP15 Forward primer (96084) |
| 95 | QTL6SNP15 Reverse primer (96085) |
| 96 | QTL6SNP16 Forward primer (96086) |
| 97 | QTL6SNP16 Reverse primer (96087) |
| 98 | QTL6SNP17 Forward primer (96088) |
| 99 | QTL6SNP17 Reverse primer (96089) |
| 100 | MZA5002 Forward primer (82263) |
| 101 | MZA5002 Reverse primer (82264) |
| 102 | MZA13321 Forward primer (82328) |
| 103 | MZA13321 Reverse primer (82329) |
| 104 | MZA15785 Forward primer (82326) |
| 105 | MZA15785 Reverse primer (82327) |
| 106 | MZA13118 Forward primer (82324) |
| 107 | MZA13118 Reverse primer (82325) |
| 108 | MZA11771 Forward primer (82314) |
| 109 | MZA11771 Reverse primer (82315) |
| 110 | MZA9351 Forward primer (82334) |
| 111 | MZA9351 Reverse primer (82335) |
| 112 | MZA8135 Forward primer (82336) |
| 113 | MZA8135 Reverse primer (82337) |
| 114 | DGAT1-2 ASK Forward primer (94784) |
| 115 | DGAT1-2 ASK Reverse primer (94785) |
| 116 | 263762-bp genomic fragment (Mo17) |
| 117 | 11915-bp genomic fragment (Mo17) |
| 118 | 6369-bp genomic fragment (Mo17) |
| 119 | Complementary strand to ZmDGAT1-2(Mo17) promoter |
| 120 | ZmAAP1 promoter |
| 121 | ZmPESP(Mo17) promoter |
| 122 | ZmS24 promoter |
| 123 | ZmABCT promoter |
| 124 | DGAT1-2 ASK forward primer |
| 125 | DGAT1-2 ASK reverse primer |
| 126 | DGAT1-2 ASK forward primer |
| 127 | DGAT1-2 ASK reverse primer |
| 128 | 82725-bp ASKC28IB1 genomic sequence |
| 129 | ZmPESP(ASK) promoter |
| 130 | Complementary strand to ZmDGAT1-2(ASK) promoter |
| 131 | ZmFAD2-1 encoding sequence |
| 132 | ZmFAD2-1 amino acid sequence |
| 133 | FAD2 inhibitory polynucleotide sequence |

Example 10

Final Mapping of QTL6 to a Single Gene (DGAT1-2)

To map QTL6 further down to a single gene, new SNP markers were developed from the 3 BAC clone sequences and used to genotype approximately 4,000 BC5S1 seedlings segregating for QTL6. Oil and oleic data were obtained from 14 critical recombinants. Data show that QTL6 is located between BAC17 and BAC22, a region of approximately 5.0 kb, containing coding sequence for the C-terminal half of DGAT1-2 (4050 bp; encoding amino acids 196 to 495), the 3'-UTR (409 bp), and possibly the terminator region (542 bp) of DGAT1-2 (FIG. 40). Therefore, QTL6 has been mapped to a region within a single gene, DGAT1-2. Data also show that this region controls both embryo oil and oleic acid concentrations as no segregation of high oil and high oleic acid phenotypes was observed within this interval.

As shown in Table 3 herein above, there are only four amino acid changes within the DGAT1-2 of the ASK high-oil, high oleic acid allele (i.e., ZmDGAT1-2(ASK) shown in SEQ ID NO:48) when compared to the DGAT1-2 of the EF09B normal-oil allele (i.e., ZmDGAT1-2(EF09B) shown in SEQ ID NO:52). These changes include the $Val_{45} \rightarrow Gly_{45}$ substitution; the $Pro_{55} \rightarrow Ser_{55}$ substitution; deletion of the glutamine residue corresponding to $Gln_{64}$ or $Gln_{65}$ or $Gln_{66}$ or $Gln_{67}$ of the DGAT1-2 of the EF09B allele; and insertion of $Phe_{467}$ or $Phe_{468}$ or $Phe_{469}$ within the DGAT1-2 of the ASK high-oil allele. Within the final QTL6 map position (between BAC17-BAC22), the $Phe_{467}$ or $Phe_{468}$ or $Phe_{469}$ insertion in the DGAT1-2 of the ASK allele is the only amino acid change between the two mapping parents (depicted as the $Phe_{469}$ insertion (/469F) in FIG. 40). This suggests that the polymorphism within the ASK high-oil, high oleic acid allele that results in the $Phe_{467}$ or $Phe_{468}$ or $Phe_{469}$ insertion in the DGAT1-2 of the ASK allele plays a crucial role in increasing oil and oleic acid contents.

Example 11

Confirmation of QTL6 in Transgenic Corn

The fine mapping result described in Example 10 above was confirmed in transgenic corn. Constructs containing embryo-preferred 16-kD oleosin promoter driving expression of the ASKC28IB1 (referred to as ASK; SEQ ID NO:47) or EF09B (SEQ ID NO:51) allele of DGAT1-2 cDNA were transformed into maize by *Agrobacterium* infection. The constructs also contained a DS-RED driven by an aleurone-specific lipid-transfer protein 2 (LTP2) promoter to facilitate segregation of transgenic and null kernels for phenotypic analysis. Oil data and fatty acid profiles were obtained from segregating T1 kernels.

On average, overexpression of the ASK allele led to a 27%, 26%, and 80% increase in embryo oil concentration, seed oil concentration, and oleic acid concentration, and a 28% decrease in linoleic concentrations, about 2-3 times the effects caused by the EF09B allele (FIG. 41). The increases caused by overexpression of the ASK allele were also more significant than those caused by the native ASKC28IB1 allele observed in BC4S2 NILs (FIG. 41). Transgenic kernels overexpressing the EF09B allele of DGAT1-2 also showed changes in all four traits. DGAT catalyzes the final step in oil biosynthesis and has been implicated as the rate limiting step. Without being bound by any theory or mechanism of action, overexpression of the EF09B allele of DGAT1-2 likely overcomes this rate limiting step leading to changes in these four oil traits.

Together, these data indicate that DGAT1-2 is the causal gene for QTL6 and is responsible for the increased oil and oleic acid contents in maize.

Example 12

DGAT1-2 and Critical Phenylalanine Residue Insertion Confirmed with QTL6 Gene in Yeast As noted above, the extra phenylalanine residue located at position 469 of the DGAT1-2 protein for the ASKC28IB1 allele (i.e., $Phe_{469}$ of SEQ ID NO:48, also referred to as F469) when aligned with the normal oil DGAT1-2 protein for the EF09B allele (see FIG. 30B) could represent the result of an insertion of this residue between the following pairs of residues in the corresponding normal oil DGAT1-2 protein (SEQ ID NO:52) for the EF09B allele: between $Trp_{467}$ and $Phe_{468}$ of SEQ ID NO:52, between $Phe_{468}$ and $Phe_{469}$ of SEQ ID NO:2, or between $Phe_{469}$ and $Ser_{470}$ of SEQ ID NO:2. To determine whether the insertion represented by residue position 467, 468, or 469 of the DGAT1-2 protein for the ASKC28IB1 allele is responsible for the high oil/high oleic acid phenotypes, the enzymatic activities of DGAT1-2 from different DGAT1-2 alleles was measured in yeast.

A *Saccharomyces cerevisiae* DGA1 (DGAT) deletion strain (Clone ID: 12501) was purchased from Invitrogen and used to create a double mutant (ΔyDGAT, ΔyPDAT) deficient in TAG-biosynthesis by removing LRO1 (phospholipid:diacylglycerol acyltransferase, or PDA T) gene using homologous recombination. The ASKC28IB1 or EF09B allele (ZmDGAT1-2(ASK) ORF of SEQ ID NO:47 and ZmDGAT1-2(EF09B) ORF of SEQ ID NO:51, respectively) or their mutant forms (ZmDGAT1-2(ASK) ORF with the TTC codon at nt positions 1405-1407 deleted, encoding mutant ZmDGAT1-2(ASK) having the sequence set forth in SEQ ID NO:48 with the $Phe_{469}$ residue deleted; and ZmDGAT1-2(EF09B) ORF with a TTC codon inserted immediately following nt 1407 of SEQ ID NO:51, encoding mutant ZmDGAT1-2(EF09B) having the sequence set forth in SEQ ID NO:52 with a phenylalanine residue insertion between $Phe_{469}$ and $Ser_{470}$ of SEQ ID NO:52) were cloned into PTS416 (Stratagene) containing a 1.0-kb promoter and a 0.5-kb terminator from *S. cerevisiae* 3-phosphoglycerate kinase (PGK1). The resulting plasmids and vector only were used to transform the yeast double mutant.

The amount of TAG in the transformed cells was determined. Briefly, 20 ml of yeast culture grown for 54 hr was harvested. Lipases were inactivated by heating at 80° C. for 10 min in the presence of 1 ml isopropanol. Cells were lysed by vortexing in the presence of 0.5 ml glass beads and 0.5 ml of 0.15 M acetic acid. As an internal control, 50 μg of TAG (C17:0) was added to each sample. Total lipids were extracted with 3 ml extraction buffer (chloroform:methanol=2:1), washed with 1.5 ml of chloroform. The organic phase was combined and dried under nitrogen stream, then dissolved in 100 μl chloroform. One-half of the samples (50 μl) were loaded onto TLC plates, developed with hexane/ether/acetic acid (70:30:1) and followed by a brief stain with iodine vapor. The corresponding bands were scraped off for GC analysis similar to that described above. Total TAG contents were calculated based on the sum of experimental values for C16:0, C16:1, C18:0, and C18:1.

The method of Milcamps et al. (2005) *J. Biol. Chem.* 280: 5370-5377 was followed with minor changes for microsomal protein preparation. Yeast cultures were grown to early stationary phase in SC media minus uracil. Following harvest, the yeast pellets were resuspended in 4 ml of 20 mM Tris- HCl, pH 8, 10 mM MgCl$_2$, 1 mM EDTA, 5% glycerol, 1 mM DTT, and 0.3 M (NH$_4$)$_2$SO$_4$. Two ml of glass beads were added, and cells were lysed by vortexing for 5 min. The lysate was centrifuged for 15 min at 1500 g at 6° C. The supernatant was then centrifuged at 100,000 g for 1.5 h at 6° C. The microsomal pellet was resuspended in 500 µl of 100 mM potassium phosphate, pH 7.2 containing 10% glycerol and frozen in liquid nitrogen prior to storage at −80° C. Protein concentrations were determined by the method of Bradford, using the Coomassie Plus reagent (Pierce), with bovine serum albumin as a standard.

DGAT assays were done for 1 min at 25° C., with 50 mM potassium phosphate pH 7.2, 10 µM 1-$^{14}$C-labelled oleoyl-coenzyme A (50 mCi/mmol, Perkin Elmer), and 20 µg of microsomal protein in a total reaction volume of 100 µl volume. The reaction was started by adding microsomal protein. The assay was stopped and lipids were extracted with 2 ml of hexane:isopropanol (3:2) (Hara and Radin (1978) *Anal. Biochem.* 90:420-426) containing 4 µl of unlabeled triacylglycerol (triolein, Sigma). Following vortexing for 10 sec, the phases were separated with 1 ml of 500 mM sodium sulfate and vortexing was again done for 10 sec. After 10 min, the upper phase was transferred to another tube and dried with nitrogen gas. The lipid was resolubilized in a small volume of hexane (approximately 100 to 150 µl) and applied to K6 silica TLC plates, which were developed in 80:20:1 (v/v) hexane: diethylether:acetic acid. Triacylglycerol was visualized and marked by staining in iodine vapor. After the stain faded, the triacylglycerol was scraped, and radioactivity was determined by liquid scintillation counting.

Figure 42B:
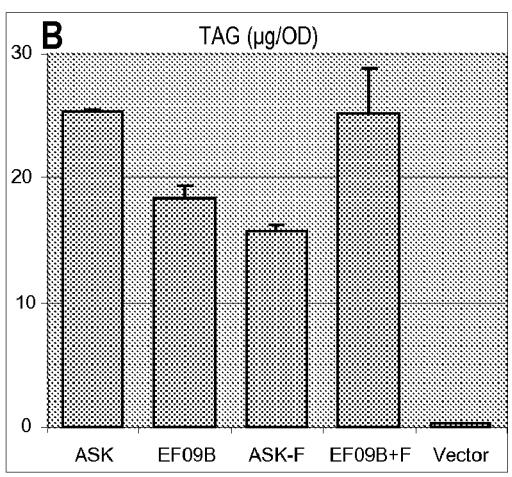

Yeast cells containing ASKC28IB1 DGAT1-2 allele (ZmDGAT1-2(ASK) ORF shown in SEQ ID NO:47) had 2-3 times higher DGAT enzyme activities than those containing the EF09B DGAT1-2 allele (ZmDGAT1-2(EF09B) ORF shown in SEQ ID NO:51). More importantly, when Phe$_{469}$ was deleted from the DGAT1-2 of the ASKC28IB1 allele (using the mutant ZmDGAT1-2(ASK) ORF where nt 1405-1407 (TTC codon) of SEQ ID NO:47 were deleted), the DGAT enzyme activity within these yeast cells was reduced to a level similar to that observed for yeast cells containing the EF09B DGAT1-2 allele. Inserting a phenylalanine residue between Phe$_{469}$ and Ser$_{470}$ of the normal oil DGAT1-2 (using the mutant ZmDGAT1-2(EF09B) ORF with a TTC codon inserted immediately following nt 1407 of SEQ ID NO:51), which results in a mutant ZmDGAT1-2(EF09B) with the phenylalanine residue corresponding to the Phe$_{469}$ of the ZmDGAT1-2(ASK) protein, restored the enzyme activity to the level observed for yeast cells comprising the ASKC28IB1 allele (i.e., ZmDGAT1-2(ASK) ORF of SEQ ID NO:47). See FIG. 42A. The amount of TAG accumulated in these cells correlated very well with the level of DGAT activities (FIG. 42B). These results again indicate that DGAT1-2 is the gene responsible for QTL6 and that a single amino acid residue, Phe$_{469}$ within the ZmDGAT1-2(ASK) protein is responsible for the increased DGAT enzyme activity and TAG accumulation in yeast.

Example 13

ASKC28IB1 Allele of DGAT1-2 is Associated with High Oil/High Oleic Acid Germplasm As shown in FIG. 33, the Phe$_{469}$ (F469) residue appears to be present in all plant type I DGATs and is only missing from certain corn inbreds with normal oil contents. To determine which allele is ancestral in corn, a DNA fragment surrounding the location of the codon for F469 was amplified from 50 accessions of Teosinte lines using SEQ ID NOs:126 and 127 as primers, and the resulting PCR products were sequenced. Sequencing results show that all 50 lines of Teosinte contain F469, having the same allele as maize ASKC28IB1 inbred, suggesting that the ASKC28IB1 allele with F469 is ancestral and that the EF09B allele is a deletion mutation.

The same DNA fragment from 73 proprietary and public corn inbreds with various levels of embryo oil and oleic acid concentrations was amplified and sequenced. Results show that the ASKC28IB1 allele with F469 is found exclusively in corn inbreds with both high oil and high oleic acid contents (FIG. 43A).

As a comparison, a DNA fragment at the 5' end of the DGAT1-2 gene, encompassing the region comprising all three amino acid changes described earlier (the Val$_{45}$→Gly$_{45}$ substitution (also referred to as V45G); the Pro$_{55}$→Ser$_{55}$ substitution (also referred to as P55S); and deletion of the glutamine residue corresponding to Gln$_{64}$ or Gln$_{65}$ or Gln$_{66}$ or Gln$_{67}$ of the DGAT1-2 of the EF09B allele (also referred to as Q64 or Q65 or Q66 or Q67) was amplified and sequenced (using SEQ ID NOs:124 and 125). In contrast to F469, the ASKC28IB1 alleles for these three amino acids are not exclusively associated with high oil and high oleic acid corn inbreds. For example, Gly$_{45}$ (also referred to as G45) found in ASKC28IB1 is also found in corn inbreds with normal to low levels of oil and oleic acid contents, not exclusively in the high oil and high oleic acid group (FIG. 43B). These data are consistent with the QTL6 fine mapping and yeast expression results.

Example 14

QTL6 (DGAT1-2) and FAD2 Have Additive Effects in Increasing Oleic Acid Concentration The maize FAD2 gene encodes a delta-12 fatty acid desaturase that catalyzes the desaturation of oleic acid to form linoleic acid. Allelic variation in the FAD2 gene is a major contributor to oleic acid levels in corn germplasm. Proprietary inbred GR1B5 contains a favorable allele for oleic acid content and has an oleic acid level of about 40%. To determine if QTL6 and the FAD2 in GR1B5 are additive, a cross was made between GR1B5 and a QTL6 BC3S2 (in EF09B background) line containing homozygous ASKC28IB1 alleles for the DGAT1-2 gene, and F2 seeds were subsequently produced. The DGAT1-2 and FAD2 genotypes were determined in 200 segregating F2 seeds from one ear. Oleic acid concentration for each seed was also determined. Oleic acid levels in different genotype groups were compared. Data show that QTL6 (DGAT1-2) and FAD2 genes have additive effects in increasing oleic acid concentration (FIG. 44). F2 seeds containing homozygous ASKC28IB1 alleles of DGAT1-2 and homozygous unfavorable alleles of FAD2 have an oleic acid level of approximately 38%, whereas seeds containing homozygous favorable alleles of FAD2 alone have about 40% oleic acid. On the other hand, seed oleic acid levels are greater than 50% when homozygous favorable alleles for both DGAT1-2 and FAD2 are present.

The additive effect for increasing oleic acid concentration by stacking the high oil/high oleic acid DGAT1-2(ASK) allele with favorable FAD2 alleles can also be achieved by transgenic approaches. For example, desirable maize lines transgenic for the ZmDGAT1-2(ASK) ORF sequence and an inhibitory sequence that targets expression of FAD2 are produced. Any inhibitory sequence that reduces or knocks out FAD2 expression can be used to decrease the activity/expression of FAD2 such that the conversion of oleic acid to linoleic acid is inhibited, thereby favoring the accumulation of oleic acid. Examples of FAD2 inhibitory polynucleotide sequences and inhibitory constructs include, but are not limited to, those disclosed in U.S. Patent Application Publication No. 2005-0160494 and WO 2005/063988, herein incorporated by reference in their entirety.

In this manner, transgenic plants comprising the ZmD-GAT1-2(ASK) ORF of SEQ ID NO:47 and an expression cassette comprising the FAD2 inhibitory sequence set forth in SEQ ID NO:133 are produced in order to confer the additive effect of increasing oleic acid concentration in seeds of these transgenic plants beyond that associated with the presence of the ZmDGAT1-2(ASK) ORF. These transgenic plants are obtained by stacking the ZmDGAT1-2(ASK) ORF sequence with this FAD2 inhibitory sequence, for example, by traditional breeding of a transgenic plant line comprising an expression cassette comprising the FAD2 inhibitory sequence with a plant line comprising the favorable ZmD-GAT1-2 marker locus defined by ZmDGAT1-2(ASK) of SEQ ID NO:47. With this stacking approach, the plant line carrying the favorable ZmDGAT1-2 marker locus is obtained through traditional breeding methods, or is obtained via a transgenic approach, for example, via transformation with an expression cassette comprising this favorable marker locus.

Alternatively, stacking is achieved by transgenic approaches, where a plant line is transformed with the ZmD-GAT1-2(ASK) ORF operably linked to a promoter that is functional in a plant cell, and an expression cassette comprising the FAD2 inhibitory sequence. The ZmDGAT1-2(ASK) ORF and operably linked promoter is introduced into the plant on a separate expression cassette, on the same or a different vector, or on the same expression cassette that comprises the FAD2 inhibitory sequence.

All publications and patent applications mentioned in the specification are indicative of the level of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, certain changes and modifications may be practiced within the scope of the appended claims.

SEQUENCE LISTING (133 sequences)

SEQ ID NO: 1 - DNA, 523 bp, Zea mays
  misc_feature (1)...(523): BAC05-ASK Marker
cgagaaaagcctattgacttgagaacgaggacaatgtctatgaaatctaagtcttagtggcttcctcaacattgtggaagtagtcaagcctttgtgacgagttgaaccatgagataaacatgtgtccttgtgttgtttacttatttcaagatttacttgttcatataaaatttctatggtttggtcttgatctatcatattgtgatatatagagagctttctgttgtcgcattagcttttactctatcctaggtgaattagaaatttactcgatctagttaaagtttgaattaggctcgggcagttttggatgctcaatagtgccgctcacaccctgacagtgctaggccacgacactactgagtgtcaaaacggtagtactgctcatgttgttaatcagtacttaagtgtcatttttacgggcccattcaccccctcccctctaagcttagcaatttcttacaagtggtatcaaagcaagtttcctcttttacgcttaactacgtaaggaatggctatgcaa

SEQ ID NO: 2 - DNA, 524 bp, Zea mays
  misc_feature (1)...(524): BAC05-EF09B Marker
cgagaaaagcctattgacttgagaacgaggacagcgtctatgaaatctaagtcttagtggcttcctcaacatcatggaagtagtcaagcgtttgtgacgagttgaaccacgagataaacatatgtgtccttgtgtttcttacttatttcaagatttacttgttcatataaaatttctatggtttcatcttgatgtatcatattgtgatatataaagagctttctgttgttgcattagcttttactctatcctaggagaattagaaatttactcgatctagttaaagtttgaattaggctcgggcagttttggatgctcaatagtgccgctcacactctgacagtgctaggccacgacagtactgagtgtcaaacggtagtactgctcatgttgttaatcagttcttaagtgtcatttttacgggcccattcaccccctcccctctaagtttagcaatttcttacaagtggtatcaaagcacgtttcctcttttatgcttaactacgtaaggaatggctatgcaa

SEQ ID NO: 3 - DNA, 507 bp, Zea mays
  misc_feature (1)...(507): BAC17-ASK Marker
cagattaacatgtcaatgcattaccttttcagtacttttggacaatacccttatatcataatttgtatgtgcataagagacaagcttcatccacatgatgctcgcaagaaacattagcacaaatccagatagtactgctgagtcacacctgaaatttttcggaatatgactgaactgataatccataattgatgcatgggacactatcttttcaagtaacatttcttggcaattataacaaacttaaactaaacaacataaggcatcaaccatacaacattcttaactcttgcagtctcactgacaatataatcaatgaaaaggtaacttgctcctaatgcctctttttgagagataacaattgactcaaccaaagtctactacttgcacatcaacatcagaaatactacagtttgtttattcaatttgcaagcatgtgaacaaatatatccaatttttgttgtacaatggaaagatcagcttcatgttaggaaaggggttacaagc

SEQ ID NO: 4 - DNA, 507 bp, Zea mays
  misc_feature (1)...(507): BAC17-EF09B Marker
cagattaacatgtcaatgcattaccttctcagtacttttggacaatacccttatatcataatttgtatgtgcataagagacaagcttcatccacatgatgctcgcaagaaacattagcacaaatccagatagtactgctgagtcacacctgaaatttttcggaatatgactgaactgataatccataattgatgcatgggacaatatcttttcaagtaacatttcttggcaattataacaaacttaaactaaacagcataaggcatcaaccatacaacattcttaactcttgcagtctcacagaaaatataatcaatgaaaaggtaacttgctcctaatggctctttttgagagataacaattgactcaaccaaagtctactacttgcacatcaacatcagaaatactacagtttgtttattcaatttccaagcatgtgaacaaatatatccaatttttcttgtacaatggaaagatcagcttcatgttaggaaaggggttacaagc

SEQ ID NO: 5 - DNA, 257 bp, Zea mays
  misc_feature (1)...(257): BAC18-ASK Marker
gcacttgtttgcaacaactactattgtggttgcttgctacaaaagtacatcctactctcacataatagtatactccctctgatttttttacctgacagtgtgcaattcaaaattacctaagtggagacaaatataaacaaacggaggtagtactatttactgcacaaacaagtgcttatgctgtaaaatagtgcagccaaacaacttctttgcttcaacttctgctttttcaaagcaccacgttcaaaagttgatcc

SEQ ID NO: 6 - DNA, 257 bp, Zea mays
  misc_feature (1)...(257): BAC18-EF09B Marker
gcacttgtttgcaacaactactattgtggttgcttgctacaacagtacatcctactctcacataatagtataccccctctgatttttttacctgacagtgtgcaattcaaaattacctaagtggagacaaatataaacaaacggaggtagtactatttactgcacaaacaagtgcttatgctgtaaaatagtgcagccaaacaacttatttgcttcaacttctactttttcaaagcaccacgttcaaaagttgatcc

SEQ ID NO: 7 - DNA, 511 bp, Zea mays
  misc_feature (1)...(511): BAC20-ASK Marker
tgtatgtgcttgcgcgttacgacagtagtaaaaaaatgtatgaaacataaatacgaaacaacaaacataactacaacatgcaaaatttgtgtggcaaacattaccaatatcgcacaaattattcctattattaccggagcatcgctcgagatgccctcgggcgagtcggaaatacactgcttgtctggggttggtctcgagcgagttgtgaccgtgtctctcgcccggggttggtctcgtgtgagccgttatcgcgtctcccgcacgaggttggccttgggcgagttgtgactgcctgttacactcgaggatggcctcgggcgtgtcgtgactgtgtctcccgccgggagttggcctcgaacgagtcgtgactgtctgcccccccaaggatggcctcgggcgggtcgtgactgcgtctcctgcccggggttggcctagaacgagtcgtgactgcatgtcccgcccgaggatggcctcaggcgtgtcgtgactccatctcctgcctagggtg

SEQ ID NO: 8 - DNA, 432 bp, Zea mays
  misc_feature (1)...(432): BAC20-EF09B Marker
tgtatgtgcttgcgcgttacgacaatagtaaaaaaatgtatgaaacataaatacggaacaacaaacataactacaacatgcaaaattcgtgtggcaaacgttaccaatatcgcacaaattattcctattattaccggagcatcgctcgagatgccctcgggcgagtcggaaatacactgcttgtctggggttggcctcgagcgagttgtgaccgtgtctctcacccggggttggtcttgtgcgagccgttatcgtgtctcccgcacgaggttggccttaggcgagttgtgactgcctgttacacttgaggatggcctcgggcgggtcgtgactgcgtctcctgtccggggttggcctagaacgagtcgtgactgcatgtcccgcccgaggatggcctcgggcgtgtcgtgactccatctcctgcctagggtg

SEQ ID NO: 9 - DNA, 241 bp, Zea mays
  misc_feature (1)...(241): BAC22-ASK Marker
aactaggcatacggatttaaaatttcctaatacatacacgtgaatcgcctagaacgcatgcactgcagctggtaattcaccatatcggaggcgaccatgcaacatggtataataaaaagtgaataaattcaatgaaacacaccaatcattgagatcctggactcgatccaacaaagtgatatctgaacaaaggttactcaaaagcttcccgtgagaaaaataccacacgaacttggacatg

SEQ ID NO: 10 - DNA, 244 bp, Zea mays
  misc_difference (1)...(244): BAC22-EF09B Marker
aactaggcatacggatttaaaatttcctaatacatacacacgtgaatcgcctagaacgcatgcactgcagctggtaattcaccatatacgaggcgaccatgcaacatggtataataaaaagtgaacaaattcattgaaacacacccatcattgagatcctggactcgatccaacaaagtgatatctgaacaaaggttactcaaaagcttcccgtgaggaaaaataccacacgaacttggacatg

SEQ ID NO: 11 - DNA, 371 bp, Zea mays
  misc_feature (1)...(371): BAC24-ASK Marker
atcttaggactggtggaatgccaaaactgttgaagaggtgagatgcctgttaaaattgagttcgtttcttttgaagtgagaactttaaataggactgacatcaattatattctcatgtacttaaatgcgatggtattttggggctttacctcagtactggaggatgtggaacatggtaatctttttgttacttccatattcagattctatacccttttatttagttgagactttgttacttaactaaggacagttaagatggtagtggtactcttctatttagttaagacttaacttctgtcactgagcttgagatatttgtataataatatctttcaaataactgacaattagtctattttttgtcagcc

SEQ ID NO: 12 - DNA, 375 bp, Zea mays
  misc_feature (1)...(375): BAC24-EF09B Marker
atcttaggactggtggaatgccaaaactgttgaagaggtgagatgcctgttaaaattgagttcgtttcttttgaagtgagaactttaaataggactgacatcaattatattctcatgtacttaaatgtgatggtattttggggctttacctcagtactggaggatgtggaacatggtaatctttttgttacttctatattcagattctatacccttttatttagttgagactttgttacttaactaaggacagttgtgatggtagtggtactcttctatttagttaagacttccttaacttctgtcactgagcttgagatatttgtctaataatatctttcaaataactgacaattagtctattttttgtcagcc

SEQ ID NO: 13 - DNA, 510 bp, Zea mays
  misc_feature (1)...(510): BAC29-ASK Marker
taacagtgggacggcaaagaactagtcagcaaagaaaatattgatctgtgtgaataaaaaaggaagaagacaagcaatgaacctttaggcaggacaaagcctccaagaacaaagaagataagaagaaatagtgctccaccagtttgagcaatgatcatggacctgcaaagtccagctgttgctctgaaaagcccacctgccatttgctggatcaagaacacgagcagcaagtgcttgaaaaacctgcccatatacataatacaattagccattacagaattctgattccagaaatgttttagaaaaaaggactactccttcatttacctgtcagcatctggagcaaaccctatggtgtaatatgtcacaagaacccatactatagattcaataatggagaatgggattctgagaatgacgttcggtactgtgaagacccaagcaggatagaagagcaggtcccggtgcttgtagaaaaccggcaaccttgttatggtcaaggaaagctca

SEQ ID NO: 14 - DNA, 510 bp, Zea mays
  misc_feature (1)...(510): BAC29-EF09B Marker
taacagtgggacggcaaagaactagtcagcaaagaaaatattgatctgtgtgaataaaaaaggaagaagacaagcaatgaacctttaggcaggacaaagcctccaagaacaaagaagataagaagaaatagtgctccaccagtttgagcaatgatcatggacctgcaaagtccagctgttgctctgaaaagcccacctgccatttgctggatcaagaacacgagcagcaagtgcttgaaaaacctgcccatatacataatataattagccattacagaattctgattccagaaatgttttagaaaaaagggctactccttcatttacctgtcagcatctggagcaaaccctatggtgtaatatgtcacaagaacccatactatagattcaataatggagaatgggattctgagaatgacgttcggtactgtgaagacccaagcaggatagaagagcaggtcccggtgcttgtagaaaaccggcaaccttgttatggtcaaggaaagctca

SEQ ID NO: 15 - DNA, 592 bp, Zea mays
  misc_feature (1)...(592): BAC32-ASK Marker
tgaagatgtacacaaatgaattgcgcttgatgaggagccactccttgtcaaaggatgccttgaggagttcggttgtcgacaccgagtgcttcgagaatacgagggcagcctgatggcacctgctcttgtcaaacggcagcgagaggtggttctcaagctggagcccgacatggaaccgtttaaaccgctgcgcaaattctggcaccgaaacgtatctgtaaggcatctgcttgtccgcccagtactgctcctggtccttccttgatgttacctggaaaggcacccaaagaatcggtcgtcttgttgcaattcataaactttgctttcagagaatatatggttactactttactagacaagtgccgaatggtacctcctgaaggaagtccgcagtgcccttgcgctcggggcagcagaacccgcaggagtcgaagaactcgaggacgtattcacgaggtccctggtaaacgatctggccttccgacagcaggatgatgtcatcgaacaggtcgaaggtctcgggggctggctggaggagggacatgaggatggtggcctcgcccaggtgcacaatctgctggagacatttgac

SEQ ID NO: 16 - DNA, 592 bp, Zea mays
  misc_feature (1)...(592): BAC32-EF09B Marker
tgaagatgtacacaaatgaattgcgcttgatgaggagccactccttgtcaaaggatgccttgaggagttcggttgtcgacaccgagtgcttcgagaatacgagggcagcctgatggcacctgctcttgtcaaacggcagcgagaggtggttctcaagctggagcccgacatggaaccgtttaaaccgctgcgcaaattctggcaccgaaacgtatctgtaaggcatctgcttgtccgcccagtactgctcctggtccttccttgatgttacctggaaaggcacccaaagaatcggtcgtcttgttgcaattcataaactttgctttcagagaatatatggttactactttactagacaagtgccgaatggtacctcctgaaggaagtccgcagtgcccttgcgctcggggcagcagaacccgcaggactcgaagaactcgaggacgtattcacgaggtccctggtaaacgatctggccttccgacagcaggatgatgtcatcgaacaggtcgaaggtctcgggggctggctggaggagggacatgaggatggtggcctcgcccaggtgcacaatctgctggagacatttgac

SEQ ID NO: 17 - DNA, 550 bp, Zea mays
  misc_feature (1)...(550): QTL6SNP7-ASK
tgacacgtcgccgtagcaaccacccgggctgctccttccccctcccgttcctcgtctgcggcctgctcctcgctgcggccgtcgcattttccccagctgcggccgccgaagcagctgaaggcggcgctgggcacgagggccgcgcggggaaaccggaggtagaggccgaggcggaggcgcgcggggatggggttgccgtggcggaagccggcggcgaggtggtggctcagggcaatgccacggaggccaaggagggcagccttgccgacatgatcgaccgcgcgctggagaaggagttcccggagtccgagggcgagcagggcggtggaggtgcgtggatctggccaactccagggatgcatcgtcccgttcgggcgcgggatctggttctgggggcggtggcgtgtgtcggtggccgtactgtttagatctcggcctcggtggttggagcgtgtggggacgttgagaatggaggtcctatgtctgaacttggagttgcttgtgctaatctgagctctggttttgcagagaccgaccctggcagcttcaa

SEQ ID NO: 18 - DNA, 550 bp, Zea mays
  misc_difference (1)...(550): QTL6SNP7-EF09B Marker
tgacacgtcgccgtagcaaccacccgggctgctccttccccctcccgttcctcgtctgcggcctgctcctcgctgcggccgtcgcattttccccagctgcggccgccgaagcagctgacggcggcgctgggcacgagggccgcgcggggaaaccggaggtagaggccgaggcggaggcgcgcggggatggggttgccgtggcggaagccggcggcgaggtggtggctcagggcaatgccacggaggccaaggagggcagccttgccgacatgatcgaccgcgcgctggagaaggagttcccggagtccgagggcgagcagggcggtggaggtgcgtggatctggccaactccagggatgcatcgtcccgttcgggcgcgggatctggttctggggccggtggcgtgtgtcggtggccgtgctgtttagatctcggcctcggtggttggagcgtgtggggacgttgagaatggaggtcctatgtctgaacttggagttgcttgtgctaatctgagctctggttttgcagagaccgaccctggcagcttcaa

SEQ ID NO: 19 - DNA, 520 bp, Zea mays
  misc_feature (1)...(520): QTL6SNP8-ASK Marker
ggctttgggggtgcgatactttggggcagcggtggcggtggcgaccttggtgcctggtggggaggggaggagccgaggtgcgtgttttgatgcgggtgttgggccgcgcggcggctgacgcacaaaagcgcgggggcgagatggcggcctcgaaaaggggacacgtggacgggcgagcttgccaggcgtcctctccgtcaccggcttggttggaagggtccggtcgggcgagtcgtcgcaggcagcagtcgggagcgagcctgtctgtctcgtttgatcgatcgttccagccgcgttgaggctgaggatggcacgtccctcttgtggaacgtacctaaagatgggagaaaatcaaacttggggatggagatttgtgtgctccggaaaatccacacctgtaagcaccacctatatcattagtaaacgtgcctcgtacaaaatttaacatattttaaaatcaggattcctacaaacattcaacacgagttgttctaaaacttacatgagcgagagtgaaccg

SEQ ID NO: 20 - DNA, 523 bp, Zea mays
  misc_feature (1)...(523): QTL6SNP8-EF09B Marker
ggctttgggggtgcgatactttggggcagcggtggcggtggcgaccttggtgcctggtggggaggggaggagccgaggtgcgtgttttgatgcgggtgttgggccgcgcggcggctgacgcacaaaagcgcgggggcgagatggcggcctcgaaaaggggacacgtggacgggcgagcttgccaggcgtcctcaccgtcaccggcttggttggaagggtccggtcgggcgagtcgtcgcaggcagcagtcgggagcggggagcctgtctgtctcgtttgatcgatcgttccagccgcgttgaggctgaggatggcacgtccctcttgtggaacgtacctaaagatgggagaaaatcaaacttggccatggagatttgtgtgctccggaaaatccacacctgtaagcaccacctatatcattagtaaacgtgcctcgtacaaaatttaacatattttaaaatcaggattcctacaaacattcaacacgaattgttctaaaacttacatgagcgagagtgaaccg

SEQ ID NO: 21 - DNA, 464 bp, Zea mays
  misc_feature (1)...(464): QTL6SNP9-ASK Marker
ccaccacacataactagactcgtctgtgtcaagttacccatctcatgccatttttatagtatgactaaaacaaaataaatgtcctttcactactctaagcagtggcgtaggcgtgtagctagagggtgagctgggtggaccgtcgcataccttataggccgaccaccagaccaccagacacagtctatagaagcctaataaaaaaatgcgacatcagcttgacttacagcatcggcaaaacaaaaaatatcattgcagatcgttaggtcatctggctcctatggttctgccagctgacctaatgagagatcgcagccacatgttgtgtgccaccacaacaccgcccctgtcgctggtgagcgtcggttgggcacgtcacatctaactttcctctggcctacgtgtagagcctcagacctcagccagagaaggtaaattttttcctcagacctcaaacagagtgt

SEQ ID NO: 22 - DNA, 465 bp, Zea mays
  misc_feature (1)...(465): QTL6SNP9-EF09B Marker
ccaccacacataactagactcgtctgtgtcaagttacccatctcatgacgttttttataatacgactaaaacaaaataaatgtcctttcactactctaagtagtggcgtaggcgtgtagctagagggtgagccgggtggaccgtcgcataccttataggccgacccaccggaccaccaaacagtctatagaagcctaataaaaaagaatgtgacatcagcttgacttacatcatcgacaaaacaaaaaatatcatgcagatcgttaggtcatttggctcctgtggttctgccacctgacctaatgagagatygcagccacatgctgtgtgccaccacaacactgtccctgtcgctggcgagcgtcggttgggcacgacacgtctgaatttcctctggcctacgwgtagagcctcagacctcagccagagaaggtaaattttttcctcagacctcaaacagagtgt

SEQ ID NO: 23 - DNA, 514 bp, Zea mays
  misc_feature (1)...(514): QTL6SNP13-ASK Marker
ctcgcgttaaccacgcaacacaaaagtaaaacactactgaagcaagcaacgtaccctccaaccaacgtacagttgacgaaacgtcgtccatgcccctaatatatagccatatattataagaagattagctaaggagagaagagaagaagaaaaacacgattgtggaggaaatgatttctgcttctgcatcaggtgtcgtacgttgtacaggatctatatatagctagattgttcatgacattatttaaattgttcgtcgttttctcgcaagtcgcaaggttaaaagagacatacatgcatgtcgatcggaccaactcgacgccctttgaaccggagccgatcgtatcaggtacgtactagtacaacgagagagctggcatgtcaaattcaaaaactctagcagccaatgcaagtaaagaagatcgagatgcaaacaaaaggcttttaacagcaacgacgacaagccaacgaaatggatcgttttcaagcgccatagaatcgaatcggccacgcc

SEQ ID NO: 24 - DNA, 513 bp, Zea mays
  misc_feature (1)...(513): QTL6SNP13-EF09B Marker
ctcgcgttaaccacgcaacacaaaagtaaaacactactgaagcaagcaacgtaccctccaaccaacgtacagttgacgaaacgtcgtccatgcccctaatatatagccatatattataagaagattagctaaggagagaagagaagaagaaaaacacgattgtggaggaaatgatttctgcttctgcatcaggtgtcgtacgttgtacaggatctatatatagctagattgttcatgacattatttaaattgttcgtcgttttctcgcaagtcgcaaggttaaaagagacatacatgcatgtcgatcggaccaactcgacgccctttgaaccggagccgatcgtatcaggtacgtacaggtacaacgagagctggcatgtcaaattcaaaaactctagcagccaatgcaagtaaagaagagatgcaatgcaaacaaaaggcttttaacagcaacgacgacaagccaacgaaatggatcgttttcaagcgccatagaatcgaatcggccacgcc

SEQ ID NO: 25 - DNA, 505 bp, Zea mays
  misc_feature (1)...(505): QTL6SNP14-ASK Marker
ctgtcatggactaggtaaccaactcggtatctattatataattgtcccctttttagactataaaatgaggagcgaggaagcccttaggagaagatcacatctcacataacaacatttcgatggcggggcacttgagccggagtgccgaactgctggaggatactagggcacacacgccttgtcgactccatgcaccggccactgaacttgcttgtataatttttttgacatcgacgaatatagcctatgtcgaagacaaaacaatttatttcaactaaaaatacttacccatgcatctgaaccttaaattcatttctgaagcggctctacggtaaattatccttttaaagttacagtacctgagagcatctgcaatagatcctaatatcatcatcccaatccagattttaggggaaaaaagaaaaaaacaatcatccaacagtaccttcgccatgaattttggattgcattggtgggtgtcactgtcagtgacgacatctgctgc

SEQ ID NO: 26 - DNA, 506 bp, Zea mays
  misc_feature (1)...(506): QTL6SNP14-EF09B Marker
ctgtcatggactaggtaaccaactcggcatgtatcatataatagtccccctttttagactataaaatgaggagcgaggaagcccttaggagaagatcacatctcacataagaacatgtcgatggcggggcacttgagccggaatgccgaactgctggaggatactagggcacacacgccttgtcgactccacgcactggccactgaacttgcttgtatcatttttttgacatcgacgaatatagcctatgtcgaagacaaaacaaattatttcaactaaaaatacttacccatgcatctgaaccttaaattcatttctgaagcggctctacggtaaattatccttttaaagttacagtacctgagagcatctgcaatagatcctaatatcatcatcccaatccagattttaggggaaaaaagaaaaaaacaatcatccaacagtaccttcgccatgaattttggattgcattggtgggtgtcactgtcagtgacgacatctgctgc

SEQ ID NO: 27 - DNA, 410 bp, Zea mays
  misc_feature (1)...(410): QTL6SNP15-ASK Marker
ccgcaacagctagtcagcagatcgtaaccatggcggattcgaaggccgctgcggcggtgacgctccgcacgcgcaagttcatgaccaaccgtcttctctcccgcaagcagttcgtgctcgaggtcatccaccccggccgccccaacgtctccaaggttgtgggtctcgtcctctcctagttcctcggttccctgccctccgtgatggccgtcgcggtcttgacggtatttcattgttcgcgcaggcggagctcaaggagaggctggcgaagatctacgaggtgaaggacccaaactgcatcttcgtcttcaagttccgaaccaacttcggaggcggcaagtccaccggcttcggtctcatctacgacaaccttgaggccgccaagaagttcgagcccaagtaccgcctca

SEQ ID NO: 28 - DNA, 410 bp, Zea mays
  misc_feature (1)...(410): QTL6SNP15-EF09B Marker
ccgcaacagctagtcagcagatcgtaaccatggcggattctaaggccgctgcggcggtgaccctccgcacgcgcaagttcatgaccaaccgccttctctcccgcaagcagttcgtgctcgaggtcatccaccccggccgccccaacgtctccaaggtcgtgggtctcgtcctctcctagtttctcggttcccttccctcggtgatggccgtcgcggtcttgacggcatctcattgttcgcgcaggcggagctcaaggagaggctggcgaagatctacgaggtgaaggacccaaactgcatcttcgtcttcaagttccgaaccaacttcggaggcggcaagtccaccggattcggtctcatctacgacaaccttgaggccgccaagaagttcgagcccaagtaccgcctca

SEQ ID NO: 29 - DNA, 522 bp, Zea mays
  misc_feature (1)...(522): QTL6SNP16-ASK Marker
ttttgtgcactcggtacactgaagttggatgcaaagcttctgatttgattaggtttataataaaagattttgttattaagatttgttttatgtaaattacacatttataattaagctttatacatacaaccgtcgttaatgagcagtgtattaagaagtttttataaaataagacataaaatttaggtacactctatggtatcaatatatagcttagttgtcctttatatttagaagagaactgtgaggttgtacacgcgaccaaacattcgtcaactagtgcatggtcgttccacgcccacgttttattttacttccccatgcctgccactgccacgtgccaccctacgccgctgcgcgcgttcactgctccatttccgtcgatcggtagcgcgcgtgggcgtggcgctcgctccctcgccggcgtcccctcgcctatatatagtttccccgcccctattccgtctcccgaccactggccggccgggcggcaccgccatcggagtacgtacacacgtcctg

SEQ ID NO: 30 - DNA, 522 bp, Zea mays
  misc_feature (1)...(522): QTL6SNP16-EF09B Marker
ttttgtgcactcggtacactgaagttggatgcaaagcttctgatttgattaggtttataataaaagattttgttattaagatttgttttatgtaaattacatatttataattaagctttatacatacaaccgtcgttaatgagccgtgtattaagaagtttctaaaaaataagacataaaatttaggtacactctatrmtatcaatatatagcttagttgccctttatatttagaagagaactgtggggtcggacacgcgaccaaacattcgtcaactagtgcatggtcgttccacgcccacgttytattttacttccccatgcctgccamtgccacgtgccaccctacgctgctgcgcgcgttcactgctccatttccgtcgatcggtagcgcgcgtgggcgtggcgctcgctccctcgccggcgtcccctcgcctatatatagtttcctcgcccctactcsgtctcccgaccactggccggccgggcggcaccgccatcggagtacgtacacacgtcctg

SEQ ID NO: 31 - DNA, 507 bp, Zea mays
  misc_feature (1)...(507): QTL6SNP17-ASK Marker
cgggcctgtgatcctgctgctcttcgcggccatcacctactacacctcctgcctcctcaccgactgctaccgcttcggcgaccctgtcaccgggaagcgcaactacacctacactgaggccgtcgagtcctacctaggtactaagctagtacttgttacttgcgattgcaaattcatcagaagatagatgagaacaatgagtggctggcatgttgtgcaggcggccggtatgtctggttctgcggcttctgccagtacgccaacatgttcggcaccggcatcggctacaccatcacggcttctgccagcgctgcgtacgtaggcgtccctagcttcctcaactaatgactcgtgctctggttagtaaaccaacaaacaacccgatcgatcgagccatgcatgcatgtctagtgcagggctatcctcaagtccaactgcttccactggcacgggcacgacgccgactgcacccagaacacgggctcctacatcgtcggcttcggcgtg

SEQ ID NO: 32 - DNA, 507 bp, Zea mays
  misc_feature (1)...(507): QTL6SNP17-EF09B Marker
cgggcctgtgatcctgctgctcttcgcggccatcacctactacacctcctgcctcctcactgactgctaccgtttcggcgaccctgccaccgggaagcgcaactacacctacactgaggccgtcgagtcctacctaggtactagtacttgttacttgcgattgcaaattcatcagaagatagatgagaacaatgagtgcctggcatgcatgttgtgcaggcggcaggtatgtctggttctgcggcttctgccagtacgccaacatgttcggcaccggcatcggctacaccatcacggcttctgccagcgctgcgtacgtaggcgtctccctagctcctcaactaatgactcgtgctctggttagtaaaccaacaaacaacccgatcgatcgagccatgcatgcatgtctagtgcagggctatcctcaagtccaactgcttccactggcacgggcacgacgccgactgcacccagaacacgggctcctacatcgtcggcttcggcgtg

SEQ ID NO: 33 - DNA, 553 bp, Zea mays
  misc_feature (1)...(553): MZA5002-ASK Marker
aagtcgcgcgagttcatggtggagctgggcctccccgacgggctcctcccgctgcccagcctggacgaggtgggctacaaccggtcgacggggttcgtgtggctgcggcaggccgccggcctgacccacaccttcggctccatcggcaagcaggtgtggtacgacagggaggtgacggcgttcgtggagcccgggcggatgcacggcctcgccggggtgaagagcaaggagctcctcatctgggtcaccatctccgagatcgtcctcagcccctccggcaccaagatcgtgttccgcacccccgcggggctcgggcgcgccttccctgtcaccgccttccagctcgagcccgagggggaccacaaggccgaggacgccgccgccgccgccgccgccgccaactgatctgctctagctagcttccggcgccggcggccgtgcgtgggctgctcgatccggtagtggcagtggctttgtgagacagtcgagtcgattgtggtttcccctcctccgccccgcagtgtgcgtgtagtggatgatgatgcaggaataa

SEQ ID NO: 34 - DNA, 564 bp, Zea mays
  misc_feature (1)...(564): MZA5002-EF09B Marker
aagtcgcgcgagttcatggtggagctgggcctccccgacgggctcctcccgctgcccaggctcgacgaggtgggctacaaccggtcgacggggttcgtgtggctgcggcaggccgccggcctgacccacaccttcgggtccatcggcaagcaggtgtggtacgacagggaggtgacggcgttcgtggagccggggcggatgcacggcctcgccggggtgaagagcaaggagctcctcatctgggtcaccatctccgagatcgtcctcagcccctccggcaccaagatcgtgttccgcacccccgcggggctcggccgcgccttccctgtcaccgccttccagctcgagcccgcggcggccgagggggaccacaaggaggaggccgaggacgccgccgccgccgccgccaactgatctgctctagcttccggcgccggcgccggcggccgtgcgtgggctgctcgatccggtagtggcagtggctttgtgagacagtcgagtcgattgtggtttcccctccttcgccccgcagtgtgcgtgtagtggatgatgatgcaggaataa

SEQ ID NO: 35 - DNA, 972 bp, Zea mays
  misc_feature (1)...(972): MZA13321-ASK Marker
cagcaaggagctgagacaaattttctgaattcacttaatcatgttcagaagatagagatgataagtggcatcaatgacatgaagaatgagtttcagtcctttctggtaacaatcttttcttatttgattgagatgagtaggtgaaagctttttggtagttgaatgagattggagaaaattgttacttaatgcttcttgctaaaacacaggacaatagttccaagaagtaaacatggtttttgacaactgtacaggatttgagaaaattgttacctgatagtctgatatttcttttttaaacatacgacaaccattcaaagaagtggacctgcatgttttaaaactttactcagatgaacctgctgcccattttgttctttttcatccttaagtctaagacaacataagaagttcgtggccttcaattccgttttcatgtttttctagtgtgttagactgtatgcagcttgattttgtttgctgaatttacttttcaatttaacaatatatttgtcctgttcgtgtttcttaattcagaaaagaggaatgccattccatttttgtcgatgcatttgcttccatgttccgttttaatatgttatgttggcatctgattttatccggtcatctcattggtgtttttgctttacctgatacattgagcaggagtccttcgatgcatcaaaaccggtaacatctgatgatatacattcattcttcgagaatcttgctaagaagaagaaacagaggttatcttagcttttgtgaccgcatcggaccccacctgaggcaatcgttctgctggacagaggtcctagtttgttgggctagtaaatgtaatgttatcttaggtggtacttactaatcgggccaataatgttgaattctagctggaacgcggtaatgtaatgatgcaccgaagtcgcttgcagtaggttcccgatgccccaagccaccaaaaacttgtttgct

SEQ ID NO: 36 - DNA, 474 bp, Zea mays
  misc_feature (1)...(474): MZA13321-EF09B Marker (partial)
cagcaaggagctgagaaaaattttytgaattyacttaatcatgttcagaagatagagatgataagtggcatcaatgacatgaagaatgagtttcagtcctttctggtaagaatcttttcttatttgattgagatgagtaggtgaaagctttttggtagttgaatgagattggagaaaattgttacttaatgcttcttgctaaaacacaggacaatagttccaagaagtaaacatggtttttgacaactgtacaggatttgagaaaattgttacctgatagtctgatatttcttttttaaacatacgacaaccattcaaagaagtggacctgcatgttttaaaactttactcagatgaacctgctgcccattttgttctttttcatccttaagtctaagacaacataagaagttcgtggccttcaattccgttttcatgtttttctagtgtgttagactgtatgcagcttgattt

SEQ ID NO: 37 - DNA, 469 bp, Zea mays
  misc_feature (1)...(469): MZA15785-ASK Marker
cccagctcaacaaggacggtgaagacgatgtctgaagtggaagcctttgccttgagggctgaagacttgaggtttgtggccacccagttccgacgactccacagcaaacagctccagcacactttcaggttctactcgcagcagtggaggacctgggccgcctgcttcatccaagctgcctggcaccggtactgcaggaagaagatcgaggattctttgcgtgagaaggagaagaggctgcagttcgcgattgccaacgacagctccacttcgctcagcttcatggcagcgctgtatgcttcgcggttcgctgggaatatgatacagatcctgaggagaaacgccacgcgcaaggccaggctgcaggaaagagtgcccgcgagactgctgcagaaaccggcagaacccaacttttccgcagaagagcagtagtatttcgcttctctgacttctcgttttgcagatacag

SEQ ID NO: 38 - DNA, 469 bp, Zea mays
  misc_feature (1)...(469): MZA15785-EF09B Marker
cccagctcaacaaggacggtgaagacgatgtctgaagtggaagcctttgccttgagggctgaagacttgaggtttgtggccacccagttccgacgactccacagcaaacagctccagcacactttcaggttctactcgcagcagtggaggacctgggccgcctgcttcatccaagctgcctggcaccggtactgcaggaagaagatcgaggattctttgcgtgagaaggagaagaggctgcagttcgcgattgccaacgacagctccacttcgctcagcttcatggcagcgctgtatgcttcgcggttcgctgggaatatgatacggatcctgaggagaaacgccacgcgcaaggccaggctgcaggaaagagtgcccgcgagactgctgcagaaaccggctgaacccaacttttccgcagaagagcagtagtatttcgcttctctgacttctcgttttgcagatacag

SEQ ID NO: 39 - DNA, 413 bp, Zea mays
  misc_feature (1)...(413): MZA13118-ASK Marker
ggcgatgcagaaggtcgggatgcttgacgtgctcatcggcgagggcaagggccaggtaaggaagcagtgccgcctggtgaacgggcaggagaaggagcagaagcagcagcagccaccggaggagcaggaggagcagcagccaccggagctggaggaggaggagcagcagcagccgcatcagccacagcttccatggttcctgcagaggcagcgcccgcccgttcttcttccatggctccggccccatccacggccgcgtcgaccgttccggaaacatccggtggccgacctggttaacggatttttccgtggttttcactgaaggcgagcactatgctcgggacgtagacctccaaaatatgcaatggtacggtacatatcaatggacgtaaaccggtgtatccatgagctta

SEQ ID NO: 40 - DNA, 413 bp, Zea mays
  misc_feature (1)...(413): MZA13118-EF09B Marker
ggcgatgcagaaggtcgggatgcttgacgtgctaatcggcgagggcaagggccaggtaaggaagcagtgccgcctggtgaacgggcaggagaaggagcagaagcagcagcagccaccggaggagcaggaggagcagcagccaccggagctggaggaggaggagcagcaacagccgcatcagccacagcttccatggttcctgcagaggcagcgcccgcccgttcttcttccatggctccggccccatccacggccgcgtcgaccgttccggaaacatccggtggccgacctggttaacggatttttccgtggttttcactgaaggcgagcactatgctcgggacgtagacctccaaaatatgcaatggtacggtacatatcaatggacgtaaaccggtgtatccatgagctta

SEQ ID NO: 41 - DNA, 457 bp, Zea mays
  misc_feature (1)...(457): MZA11771-ASK Marker
aggtcactgaaccaaatcagaggaagagtagaagttaagaaatgagaagtgagtggaacatcagtacaaagcatcagtggttctatctcattagagaaaaatgaagtgtcacatataagagaattttcacaagtaattgccagctaactaaaagctatgacaactggaccaccacgaaaaatgtaaggtccaagtttacaaattccacgcaatcgtccatgatcaaaattttaacacgtgagagatgcaaaggatgcaatagcaagcaaaatggatcagtacaaaacaggtcactttaggtaagccaattggaccgcctcaaacaatgcatagtccattttttacaaactccacacgatcttcacatgctcaaaatttcaacacatgagaaatgaaaaggatgcaatagcaattgaaaaagaaggcaggctgaagttttccctttcagtctatatcc

SEQ ID NO: 42 - DNA, 457 bp, Zea mays
  misc_feature (1)...(457): MZA11771-EF09B Marker
aggtcactgaaccaaatcagaggaagagtagaagttaagaaatgagaagtgagtggaacatcagtacaaagcatcagtggttctatctcattagagaaaaatgaagtgtcacatataagagaattttcacaagtaattgccagctaactaaaagctatgacaattggaccaccacgaaaaatgtaaggtccaagtttacaaattccacgcaatcgtccatgatcaaaattttaacacgtgagagatgcaaaggatgcaatagcaagcgaaatggatcagtacaaaacaggtcactttaggtaagccaattggaccgcctcaaacaatgcatagtccattttttacaaactccacacgatcttcacatgctcaaaatttcaacacatgagaaatgaaaaggatgcaatagcaattgaaaaagaaggcaggctgaatttttccctttcagtctatatcc

SEQ ID NO: 43 - DNA, 762 bp, Zea mays
  misc_feature (1)...(762): MZA9351-ASK Marker
atgaccttgactctcccaaggtttgttcttagaatattgtcttatggtaggctaatattatgcaatccgcttcagttggaaagttgatgaatttattatattgggtgctgcgttgttcttaaaaatttcaacccaaacacaaagtatgttataaggaatcctgcccccccgccctctaatttaacttaatttttttcttacttataaagtagactgcatatgaacatactggtaaataaatgtagattaattgaggaaaaaataatggtcagtaggtcccccaaccagattgcaaaattgcaactaatgatatggtttaccagatctaatctttaacccatctgtagttacttggttacccaagcaagccaattggtctcttcataaggcaatcaatcatcttccgttccgactccaacggtgaggacctggaaggttatgctggagcaggattatatgataggttagggaaatccctttcttgaatatatatgttaaggttcttattggtttggaatgacagataaattgtttgtttcctcagcgtaccgatggatgaggaggatgaggttgtacttgattacacaactgaccctcttatagtagaccgtggattccgaagctcaatcctctcaagcatagcacgggctggccatgccatcgaggagctatacggttctcctcaggacgtcgagggagtagtgaaggatggaaaaatctatgtagtccagacaagaccacagatgtagtatgtatgcatct

SEQ ID NO: 44 - DNA, 477 bp, Zea mays
  misc_feature (1)...(477): MZA9351-EF09B Marker (partial)
cagattgcaaaattgctactgaggatatggtttaccagatctaatctttaacctatctgtagttacttggttacccaagcaagccaattggtctcttcataaggcaatcaatcatcttccgttccgactccaatggcgaggacctggaaggttatgctggagcaggattatatgataggttagggaaatccctttcttgaatatatatgttaaggttcttattggtttggaatgacagataaattgtttgtttcctcagcgtaccgatggatgaggaggatgaggttgtacttgattacacaactgaccctcttatagtagaccgtggattccgaagctcaatcctctcaagcatagcacgggctggccatgccatcgaggagctatacggttctcctcaggacgtcgagggagtagtgaaggatggaaaaatctatgtagtccagacaagaccacagatgtagtatgtatgcatct

SEQ ID NO: 45 - DNA, 499 bp, Zea mays
  misc_feature (1)...(499): MZA8135-ASK Marker
ctgcgcatgttgtattctcatattcatagtatgtacaactaaactatgcatataaaaaaaatcttcagtgtgttatgtgtctgtcttgtgggatcccggtgccccctttctatgtcgatgtttctgtttggttatctggtcacactcagcatttacatagcactgttccatttttcttgtgacagtgggtctctacctgcacctcgctgtgtcggttgtgcatgaaatcaaggatgcccttggaatctattgcttcaggtgtggaaactggaaacctccgtgtgctcttactgctcagaaaccaccctcccatgtttttaacctctcttccgctgctgctggtattgcatacaggataactagaaaggaggcttgaactttgtagtgaagatatattattattacttcacaagtgctagcgaggagcaacacagttcgtcaccgtgcacgctgggagtgtgtgtgcccctctgaaatgccacagccatctgtttgttga

SEQ ID NO: 46 - DNA, 496 bp, Zea mays
  misc_feature (1)...(496): MZA8135-EF09B Marker
ctgcgcatgttgtattctcatattcatagtatgtacaactaaactatgcatatcaaaaaatctgcagtgtgttatgtgtctgtcttctgggattacggtgccccctttctatgtcgatgtttctgcttggttatctggtcacactcagcatttacatagcgccgttccatttttcttgtgacagtgggtctctacctgcacctcgctgtgtcggttgtgcatgaaatcaaggacgctcttggaatctattgcttcaggtgtggaaactggaaacctccgtgtgctcttactgctcaaaaaccaccctcccatgttttttttaactctcttccgctgctgctggtattgcatacaggataactagaaaggaggcttgaactttgtagtgaagataatattattacttcacaagtgctagcgaggagcaacacagttcgtcaccgtgcacgctgggagtgtgtgtgcccctgaaatgccacagccatctgtttgttga

SEQ ID NO: 47 - DNA, 1485 bp, Zea mays
  CDS (1)...(1485): ZmDGAT1-2 ORF (ASK)
atggccccgcccccctccatgcctgccgcctccgatcgcgccggccctggccgcgacgcgggcgactcgtcctcccttcgcctccgccgcgccccctcagccgacgccggcgaccttgccggcgattcctcgggaggcttgcgggagaacggcgagccgcaatcgccgacgaatccgccgccgcaggagcagcagcagcacgagatgctatactaccgcgcgtcggcgcccgcccaccgccgcgtcaaggagagccccctcagctctgacgccatcttccggcagagccatgctggtcttctgaatctatgcattgttgttctgatcgcagtgaacagcagactcattattgagaatttaatgaagtatggcctgttgataagagctggattttggtttagtgcaagatcgctgggtgactggccccttctaatgtgctgcctcactctaccagttttcccactagttgcactcatggctgagaagctgatcacaagaaagctcattggtgaacatgtggttattctactccatatcattattacaacatctgccattgtctatccagttgttgtgactcttaagtgtgactcagcagtactatctggatttgtgctaatgtttcttgcgagcatcatgtggatgaagcttgtctcttatgcacatacaaattatgatataagggtattgtccaaaagtactgaaaagggtgctgcatatggaaattatgtcgatcctgagaatatgaaagatccaacctttaaaagtctagtgtactttatgttggccccaacactttgttaccagccaacttatcctcaaactacatgtattagaaagggttgggtgacccagcaactcataaagtgcgtggtttttacaggcttgatgggcttcataattgagcaatatataaacccaattgtgaagaattccaaacatccactgaaagggaattttttgaatgctatagaaagagtcttaaaactctcagtgccaacattatatgtatggctttgcatgttctattgcttttttcatttatggctgaacattgtagctgaactcctctgtttcggtgaccgtgaattctataaggactggtggaatgccaaaactgttgaagagtactggaggatgtggaacatgcctgttcataagtggatcatcagacacatatattttccatgtataaggaaaggcttttccaggggtgtagctattctaatctcgtttctggtttcagctgtatttcatgagatatgtattgcggtgccttgccacattttcaaattctgggcattttctgggatcatgtttcagatacccttggtattcttgacaagatatctccatgctacgttcaagcatgtaatggtgggcaacatgatattttggttcttcttcagtatagtcggacagccgatgtgtgtccttctatactaccatgacgtcatgaacaggcaggcccaggcaagtagatag

SEQ ID NO: 48 - protein, 494 aa, Zea mays
MAPPPSMPAASDRAGPGRDAGDSSSLRLRRAPSADAGDLAGDSSGGLRENGEPQSPTNPPPQEQQQHEMLYYRASAPAHRRVKESPLSSDAIFRQSHAGLLNLCIVVLIAVNSRLIIENLMKYGLLIRAGFWFSARSLGDWPLLMCCLTLPVFPLVALMAEKLITRKLIGEHVVILLHIIITTSAIVYPVVVTLKCDSAVLSGFVLMFLASIMWMKLVSYAHTNYDIRVLSKSTEKGAAYGNYVDPENMKDPTFKSLVYFMLAPTLCYQPTYPQTTCIRKGWVTQQLIKCVVFTGLMGFIIEQYINPIVKNSKHPLKGNFLNAIERVLKLSVPTLYVWLCMFYCFFHLWLNIVAELLCFGDREFYKDWWNAKTVEEYWRMWNMPVHKWIIRHIYFPCIRKGFSRGVAILISFLVSAVFHEICIAVPCHIFKFWAFSGIMFQIPLVFLTRYLHATFKHVMVGNMIFWFFFSIVGQPMCVLLYYHDVMNRQAQASR

SEQ ID NO: 49 - DNA, 1485 bp, Zea mays
  CDS (1)...(1485): ZmDGAT1-2 ORF (Mo17)
atggccccgcccccctccatgcctgccgcctccgatcgcgccggccctggccgcgacgcgggcgactcgtcctcccttcgcctccgccgcgccccctcagccgacgccggcgaccttgccggcgattcctcggtaggcttgcgggagaacggcgagccgcaaccgccgacgaatccgccgccgcaggagcagcagcagcagcacgagatgctatactaccgcgcgtcggcgcccgcccaccgccgcgtcaaggagagccccctcagctctgacgccatcttccggcagagccatgctggtcttctgaatctatgcattgttgttctgatcgcagtgaacagcagactcattattgagaatttaatgaagtatggcctgttgataagagctggattttggtttagtgcaagatcgctgggtgactggccccttctaatgtgctgcctcactctaccagttttcccactagttgcactcatggctgagaagctgatcacaagaaagctcattggtgaacatgtggttattctactccatatcattattacaacatctgccattgtctatccagttgttgtgactcttaagtgtgactcagcagtactatctggatttgtgctaatgtttcttgcgagcatcatgtggatgaagcttgtctcttatgcacatacaaattatgatataagggtattgtccaaaagtactgagaagggtgctgcatatggaaattatgtcgatcctgagaatatgaaagatccaacctttaaaagtctagtgtacttcatgttggccccaacactttgttaccagccaacttatcctcaaactacatgtattagaaagggttgggtgacccagcaactcataaagtgcgtggtttttacaggcttgatgggcttcataattgagcaatatataaacccaattgtgaagaattccaaacatccactgaaagggaattttttgaatgctatagaaagagtcttaaaactctcagtgccaacattatatgtatggctttgcatgttctattgcttttttcatttatggctgaacattgtagctgaactcctctgtttcggtgaccgtgaattctataaggactggtggaatgccaaaactgttgaagagtactggaggatgtggaacatgcctgttcataagtggatcatcagacacatatattttccatgtataaggaaaggcttttccaggggtgtagctattctaatctcgtttctggtttcagctgtattccatgagatatgtattgcggtgccgtgccacattttcaaattctgggcattttctgggatcatgtttcagataccgttggtattcttgacaagatatctccatgctacgttcaagcatgtaatggtgggcaacatgatattttggttcttcagtatagtcggacagccgatgtgtgtccttctatactaccatgacgtcatgaacaggcaggcccaggcaagtagatag

SEQ ID NO: 50 - protein, 494 aa, Zea mays
MAPPPSMPAASDRAGPGRDAGDSSSLRLRRAPSADAGDLAGDSSVGLRENGEPQPPTNPPPQEQQQQHEMLYYRASAPAHRRVKESPLSSDAIFRQSHAGLLNLCIVVLIAVNSRLIIENLMKYGLLIRAGFWFSARSLGDWPLLMCCLTLPVFPLVALMAEKLITRKLIGEHVVILLHIIITTSAIVYPVVVTLKCDSAVLSGFVLMFLASIMWMKLVSYAHTNYDIRVLSKSTEKGAAYGNYVDPENMKDPTFKSLVYFMLAPTLCYQPTYPQTTCIRKGWVTQQLIKCVVFTGLMGFIIEQYINPIVKNSKHPLKGNFLNAIERVLKLSVPTLYVWLCMFYCFFHLWLNIVAELLCFGDREFYKDWWNAKTVEEYWRMWNMPVHKWIIRHIYFPCIRKGFSRGVAILISFLVSAVFHEICIAVPCHIFKFWAFSGIMFQIPLVFLTRYLHATFKHVMVGNMIFWFFSIVGQPMCVLLYYHDVMNRQAQASR

SEQ ID NO: 51 - DNA, 1485 bp, Zea mays; identical to SEQ ID NO: 49
  CDS (1)...(1485): ZmDGAT1-2 ORF (EF09B)

SEQ ID NO: 52 - protein, 494 aa, Zea mays; identical to SEQ ID NO: 50

SEQ ID NO: 53 - DNA, 1485 bp, Zea mays; identical to SEQ ID NO: 49
  CDS (1)...(1485): ZmDGAT1-2 ORF (B73)

SEQ ID NO: 54 - protein, 494 aa, Zea mays; identical to SEQ ID NO: 50

SEQ ID NO: 55 - DNA, 1389 bp, Zea mays
  CDS (1)...(1389): ZmAAP1 ORF (Mo17)
atggacgtcgacatgcaagcccgcggtggcggtggtagccatggcggcgaacttgacgacgacggcaaggagaagaggacagggacggtgtggacggcgtcggcgcacatcatcacggcggtgatcgggtccggcgtgctgtcgctggcgtgggcgatggcccagctgggctgggtggccgggcctgtgatcctgctgctcttcgcggccatcacctactacacctcctgcctcctcaccgactgctaccgcttcggcgaccctgccaccgggaagcgcaactacacctacactgaggccgtcgagtcctacctaggcggccggtatgtctggttctgcggcttctgccagtacgccaacatgttcggcaccggcatcggctacaccatcacggcttctgccagcgctgcggctatcctcaagtccaactgcttccactggcacgggcacgacgccgactgcacccagaacacgggctcctacatcgtcggcttcggcgtggtgcaggtcatcttcagccagctctcaaacttccacgagctctggtggctctccgtgctcgcggccgccatgtccttctgctactccaccatcgccgtcgggctcgccctcggccagaccatctcaggtcccacgggcaagacgacgctctacggcacgcaggtcggggtggacgttggtagcgcggaggagaagatatggctgacgttccaggctctcggcaacatcgcgtttgcctactcctacaccattgttctcattgaaatccaggacacgctgcgatctccgccggccgagaacaagacgatgcggcaggcgtcggtcctgggcgtggcgacgaccacggcgttctacatgctgtgcggctgcctgggctactcggcgttcggcaacgcggcgccgggtgacatcctgtcgggcttctacgagccctactggctggtggacttcgccaacgtctgcatcgtgatccacctcgtgggcggcttccaggtgttcctgcagccgctgttcgccgcggtcgaggccgacgtggcggcgcgctggccggcctgctccgcgcgggagcgccgcggcggcgtcgacgtgttccgcctgctgtggcgcaccgcgttcgtcgcgctcatcaccctgtgcgccgtcctgctgcccttcttcaacagcatcctgggaatcctcggcagcatcggcttctggccgctcaccgtcttcttccccgtcgagatgtacatccgccagcagcagatcccgcggttcagcgccacgtggctggcgctgcaggccctcagcatcttctgcttcgtcatcaccgtcgcggccggggctgcctcggtacagggcgtgcgcgactcgctcaaaacctacgtgcccttccagaccaggtcgtga

SEQ ID NO: 56 - protein, 462 aa, Zea mays
MDVDMQARGGGGSHGGELDDDGKEKRTGTVWTASAHIITAVIGSGVLSLAWAMAQLGWVAGPVILLLFAAITYYTSCLLTDCYRFGDPATGKRNYTYTEAVESYLGGRYVWFCGFCQYANMFGTGIGYTITASASAAAILKSNCFHWHGHDADCTQNTGSYIVGFGVVQVIFSQLSNFHELWWLSVLAAAMSFCYSTIAVGLALGQTISGPTGKTTLYGTQVGVDVGSAEEKIWLTFQALGNIAFAYSYTIVLIEIQDTLRSPPAENKTMRQASVLGVATTTAFYMLCGCLGYSAFGNAAPGDILSGFYEPYWLVDFANVCIVIHLVGGFQVFLQPLFAAVEADVAARWPACSARERRGGVDVFRLLWRTAFVALITLCAVLLPFFNSILGILGSIGFWPLTVFFPVEMYIRQQQIPRFSATWLALQALSIFCFVITVAAGAASVQGVRDSLKTYVPFQTRS

SEQ ID NO: 57 - DNA, 1896 bp, Zea mays
  CDS (1)...(1896): ZmPESP ORF (Mo17)
atgctgacacgtcgccgtagcaaccacccgggctgctccttccccctcccgttcctcgtctgcggcctgctcctcgctgcggccgtcgcattttccccagctgcggccgccgaagcagctgacggcggcgctgggcacgagggccgcgcggggaaaccggaggtagaggccgaggcggaggcgcgcggggatggggttgccgtggcggaagccggcggcgaggtggtggctcagggcaatgccacggaggccaaggagggcagccttgccgacatgatcgaccgcgcgctggagaaggagttcccggagtccgagggcgagcagggcggtgggagttcccggagtccgagggcgagcagggcggtggagaccgaccctggcagcttcaacaacacggtagctgagaagcagggagttcttgaaactgtagctagaagagtaacaaagaagaatgaaaccaaagataacaagtcatttccttttaaggaggttttcttggatcgaactgagcaagaggatgttcccacgttgatagatcggaaggataatgtttttatcatctcaaacccaaagtcaaaataccctgtgctgcagctggaccttaggttgatatcagatcttgttgttgttatcgtatccgctacatgtggtggaattgcctttgcttgccttgggcaaccggtgattacaggttatctacttgcaggatctataattgggcctggaggttttagctttgtcaatgaaatggtgcaagttgaaacggtagcccagtttggtgtgatatttctcctgtttgcattgggacttgagttttctactgcaaaacttcgagttgttcgtgctgttgctgttctcggaggattgctccaaattatgttgttcatgtttctttgtggtattttggctaccgtgctatgtggaggcaaaactaaagaaggtgtttttgttggtgttcttctctccatgtcttcaacagctgtcgtagttttaaagtttctgatggaaagaaatagtatcaatgctcttcatggccaggttacagtcgggatacttatattgcaggattgtgctgttggcctgctgtttgcgcttcttccaattttgagtggtacatctggccttcttcacggagttgcatcaatgatgaagtcgctggtggtattgataacattcctgaccattctctctatcctctcccgtaccggcgttccttggtttcttaaactgatgataagtctgtcatcacagacaaatgaactatatcagctggcagcagttgcattctgcttgttatttgcttggtgtagtgataagttgggcctgagtctcgagttgggttcttttgcagctggagtaatgatatcaacaacagaccttgcacaacatactcttgaacaacagatcgaacccatccgcaactttttcgctgctcttttccttgccagcattgggatgctaattaatgtccatttcttgtggaaccatgtggatatactccttgcagcagtaattttggtgatcaccgtaaagacctttattgttgctattgttgtaaaagggtttgggtatagcaacaaaacatctcttcttgtagtcggcatgtcacttgcacaaataggagagtttgcttttgttctcttaagccgtgcttcaagtattcatctaatcgagggcaagctatacctgcttcttcttggaaccactgcacttagtttggtaacaacccctctgctattcaaaatgatccctgcaatggtccacctcggggttcttttgagatggttttctgtcgataccaatcaggtggagcagctgggcctgaaaaatgatgtcctccgcatcgatagcggcaagcgcataaatctgatagtccaaggctcacatgactcatga

SEQ ID NO: 58 - protein, 631 aa, Zea mays
MLTRRRSNHPGCSFPLPFLVCGLLLAAAVAFSPAAAAEAADGGAGHEGRAGKPEVEAEAEARGDGVAVAEAGGEVVAQGNATEAKEGSLADMIDRALEKEFPESEGEQGGGSSRSPRASRAVETDPGSFNNTVAEKQGVLETVARRVTKKNETKDNKSFPFKEVFLDRTEQEDVPTLIDRKDNVFIISNPKSKYPVLQLDLRLISDLVVVIVSATCGGIAFACLGQPVITGYLLAGSIIGPGGFSFVNEMVQVETVAQFGVIFLLFALGLEFSTAKLRVVRAVAVLGGLLQIMLFMFLCGILATVLCGGKTKEGVFVGVLLSMSSTAVVVLKFLMERNSINALHGQVTVGILILQDCAVGLLFALLPILSGTSGLLHGVASMMKSLVVLITFLTILSILSRTGVPWFLKLMISLSSQTNELYQLAAVAFCLLFAWCSDKLGLSLELGSFAAGVMISTTDLAQHTLEQQIEPIRNFFAALFLASIGMLINVHFLWNHVDILLAAVILVITVKTFIVAIVVKGFGYSNKTSLLVVGMSLAQIGEFAFVLLSRASSIHLIEGKLYLLLLGTTALSLVTTPLLFKMIPAMVHLGVLLRWFSVDTNQVEQLGLKNDVLRIDSGKRINLIVQGSHDS

SEQ ID NO: 59 - DNA, 414 bp, Zea mays
  CDS (1)...(414): ZmS24 ORF (Mo17)
atggcggattcgaaggccgctgcggcggtgacgctccgcacacgcaagttcatgaccaaccgtcttctctcccgcaagcagttcgtgctcgaggtcatccaccccggccgccccaacgtctccaaggcggagctcaaggagaggctggcgaagatctacgaggtgaaggacccaaactgcatcttcgtgttcaagttccgaaccaacttcggaggcggcaagtccaccggcttcggtctcatctacgacaaccttgaggccgccaagaagttcgagcccaagtaccgcctcatcaggaacggccttgctaccaaggtagagaagtcacgaaagcagatgaaggaacgtaagaacagggcgaagaaaatccgtggtgtgaagaagacaaaggctggagatgccaagaagaagtaa

SEQ ID NO: 60 - protein, 137 aa, Zea mays
MADSKAAAAVTLRTRKFMTNRLLSRKQFVLEVIHPGRPNVSKAELKERLAKIYEVKDPNCIFVFKFRTNFGGGKSTGFGLIYDNLEAAKKFEPKYRLIRNGLATKVEKSRKQMKERKNRAKKIRGVKKTKAGDAKKK

SEQ ID NO: 61 - DNA, 2418 bp, Zea mays
  CDS (1)...(2418): ZmABCT ORF (5' end partial Mo17)
atggagagcgcgatggagaaggtgtgggagtcggggcggcggatgagccggagcatcgggcggggcatgggcatgggcatggagacgtggggcgtcgacgacgccttcgtgccgcagcacggctcccggtcccgcggcggcggcggcggcggcggcgacgacgacgaggaggcgctgcgctgggcggccatcgagcgcctgcccacctacagccgcgtgcgcaccgccatcctgtccacggaggccgccgccggggttgacgacgacgacgacaagccgcggcggccgccgccgcagcagcagcagttcaaggaggtggacgtgaggaagctcggcgtcggcgagcgccaggagttcatcgagcgcgtcttccgcgtcgccgaggaggacaaccagcggttcctccagaagctccgcaaccgcatcgacagggtgggcatcgagctgccgacggtggaggtgcggttcgagcggctgacggtggaggccaggtgccacgtgggcagccgcgcgctgccgacgctgctgaacacggcgcgcaacgtcgcggaggcggcgctgggcctgtgcggcgtgcggctggggggccggcaggccaggctgaccatcctcagggacgtgtccggcgccgtccgcccgtccaggatgacgctgctgctgggcccgccgtcgtccgggaagaccacgctgctgctggccctcgcgggcaagctggacccggcgctggtcgtcgccggcgtcggcggcggcgaggtctcctacaacgggttccgcctcggcgagttcgtgccgcagaagacggcggcgtacatcagccagacggacgtgcacgtcggcgagatgacggtcaaggagacgctcgacttctccgcccggtgccagggcgtcggcgccaaatacgatcttatgacggagctggccaggagggagaagggggccggcatccggccggagcctgaagtcgacctcttcatgaaggcgacttcaatggaaggagtggagaacagcctccagacggattacactctcaggatactggggctggacatctgcgccgacaccatcgtcggcgaccagatgcagcgggggatctctggcggccagaagaagcgcgtcaccacagctaacgacacagtcgagtgtcacatcctgcggttcgtgcagaaaaaaaaggaactgtgcttttgtgctgtgcctctgaggtccacacacacaagggacaccgtgcctttgattgggacgcagcagttggtagcgtaccatctcgtggttcagggattccagggggagatgatcgttggcccgaccaaggtgctgttcatggacgagatatcaactgggctggacagctccacgacgttccagatcgtcaaatgtctccagcagattgtgcacctgggcgaggccaccatcctcatgtccctcctccagccagcccccgagaccttcgacctgttcgatgacatcatcctgctgtcggaaggccagatcgtttaccagggacctcgtgaatacgtcctcgagttcttcgactcctgcgggttctgctgccccgagcgcaagggcactgcggacttccttcaggaggtaacatcaaggaaggaccaggagcagtactgggcggacaagcagatgccttacagatacgtttcggtgccagaatttgcgcagcggtttaaacggttccatgtcgggctccagcttgagaaccacctctcgctgccgtttgacaagagcaggtgccatcaggctgccctcgtattctcgaagcactcggtgtcgacaaccgaactcctcaaggcatcctttgacaaggagtggctcctcatcaagcgcaattcatttgtgtacatcttcaagaccatacagcttatcattgtagccctcatcgcgtcaacggtgtttctgagaactcacatgcatacgacgaatctagatgatggctttgtctacattggagcactgctctttactctgattgtgaatatgttcaatggttttgctgagctttccttgaccataacaaggttgccggttttctacaagcaccgggacctgctcttctatcctgcttgggtcttcacagtaccgaacgtcattctcagaatcccattctccattattgaatctatagtatgggttcttgtgacatattacaccatagggtttgctccagatgctgacaggtttttcaagcacttgctgctcgtgttcttgatccagcaaatggcaggtgggcttttcagagcaacagctggactttgcaggtccatgatcattgctcaaactggtggagcactatttcttcttatcttctttgttcttggaggctttgtcctgcctaaagttttcattcctaactggtggatctggggctactggatctcacccttgatgtatggatacaatgctctagct

SEQ ID NO: 62 - protein, 806 aa, Zea mays
MESAMEKVWESGRRMSRSIGRGMGMGMETWGVDDAFVPQHGSRSRGGGGGGGDDDEEALRWAAIERLPTYSRVRTAILSTEAAAGVDDDDDKPRRPPPQQQQFKEVDVRKLGVGERQEFIERVFRVAEEDNQRFLQKLRNRIDRVGIELPTVEVRFERLTVEARCHVGSRALPTLLNTARNVAEAALGLCGVRLGGRQARLTILRDVSGAVRPSRMTLLLGPPSSGKTTLLLALAGKLDPALVVAGVGGGEVSYNGFRLGEFVPQKTAAYISQTDVHVGEMTVKETLDFSARCQGVGAKYDLMTELARREKGAGIRPEPEVDLFMKATSMEGVENSLQTDYTLRILGLDICADTIVGDQMQRGISGGQKKRVTTANDTVECHILRFVQKKKELCFCAVPLRSTHTRDTVPLIGTQQLVAYHLVVQGFQGEMIVGPTKVLFMDEISTGLDSSTTFQIVKCLQQIVHLGEATILMSLLQPAPETFDLFDDIILLSEGQIVYQGPREYVLEFFDSCGFCCPERKGTADFLQEVTSRKDQEQYWADKQMPYRYVSVPEFAQRFKRFHVGLQLENHLSLPFDKSRCHQAALVFSKHSVSTTELLKASFDKEWLLIKRNSFVYIFKTIQLIIVALIASTVFLRTHMHTTNLDDGFVYIGALLFTLIVNMFNGFAELSLTITRLPVFYKHRDLLFYPAWVFTVPNVILRIPFSIIESIVWVLVTYYTIGFAPDADRFFKHLLLVFLIQQMAGGLFRATAGLCRSMIIAQTGGALFLLIFFVLGGFVLPKVFIPNWWIWGYWISPLMYGYNALA

SEQ ID NO: 63 - DNA, 4710 bp, Zea mays
  CDS (1)...(4710): ZmABCT ORF (composite from Mo17 genomic, B73 genomic and EST)
atggagagcgcgatggagaaggtgtgggagtcggggcggcggatgagccggagcatcgggcggggcatgggcatgggcatggagacgtggggcgtcgacgacgccttcgtgccgcagcacggctcccggtcccgcggcggcggcggcggcggcggcgacgacgacgaggaggcgctgcgctgggcggccatcgagcgcctgcccacctacagccgcgtgcgcaccgccatcctgtccacggaggccgccgccggggttgacgacgacgacgacaagccgcggcggccgccgccgcagcagcagcagttcaaggaggtggacgtgaggaagctcggcgtcggcgagcgccaggagttcatcgagcgcgtcttccgcgtcgccgaggaggacaaccagcggttcctccagaagctccgcaaccgcatcgacagggtgggcatcgagctgccgacggtggaggtgcggttcgagcggctgacggtggaggccaggtgccacgtgggcagccgcgcgctgccgacgctgctgaacacggcgcgcaacgtcgcggaggcggcgctgggcctgtgcggcgtgcggctggggggccggcaggccaggctgaccatcctcagggacgtgtccggcgccgtccgcccgtccaggatgacgctgctgctgggcccgccgtcgtccgggaagaccacgctgctgctggccctcgcgggcaagctggacccggcgctggtcgtcgccggcgtcggcggcggcgaggtctcctacaacgggttccgcctcggcgagttcgtgccgcagaagacggcggcgtacatcagccagacggacgtgcacgtcggcgagatgacggtcaaggagacgctcgacttctccgcccggtgccagggcgtcggcgccaaatacgatcttatgacggagctggccaggagggagaagggggccggcatccggccggagcctgaagtcgacctcttcatgaaggcgacttcaatggaaggagtggagaacagcctccagacggattacactctcaggatactggggctggacatctgcgccgacaccatcgtcggcgaccagatgcagcgggggatctctggcggccagaagaagcgcgtcaccacagctaacgacacagtcgagtgtcacatcctgcggttcgtgcagaaaaaaaaggaactgtgcttttgtgctgtgcctctgaggtccacacacacaagggacaccgtgcctttgattgggacgcagcagttggtagcgtaccatctcgtggttcagggattccagggggagatgatcgttggcccgaccaaggtgctgttcatggacgagatatcaactgggctggacagctccacgacgttccagatcgtcaaatgtctccagcagattgtgcacctgggcgaggccaccatcctcatgtccctcctccagccagcccccgagaccttcgacctgttcgatgacatcatcctgctgtcggaaggccagatcgtttaccagggacctcgtgaatacgtcctcgagttcttcgactcctgcgggttctgctgccccgagcgcaagggcactgcggacttccttcaggaggtaacatcaaggaaggaccaggagcagtactgggcggacaagcagatgccttacagatacgtttcggtgccagaatttgcgcagcggtttaaacggttccatgtcgggctccagcttgagaaccacctctcgctgccgtttgacaagagcaggtgccatcaggctgccctcgtattctcgaagcactcggtgtcgacaaccgaactcctcaaggcatcctttgacaaggagtggctcctcatcaagcgcaattcatttgtgtacatcttcaagaccatacagcttatcattgtagccctcatcgcgtcaacggtgtttctgagaactcacatgcatacgacgaatctagatgatggctttgtctacattggagcactgctctttactctgattgtgaatatgttcaatggttttgctgagctttccttgaccataacaaggttgccggttttctacaagcaccgggacctgctcttctatcctgcttgggtcttcacagtaccgaacgtcattctcagaatcccattctccattattgaatctatagtatgggttcttgtgacatattacaccatagggtttgctccagatgctgacaggtttttcaagcacttgctgctcgtgttcttgatccagcaaatggcaggtgggcttttcagagcaacagctggactttgcaggtccatgatcattgctcaaactggtggagcactatttcttcttatcttctttgttcttggaggctttgtcctgcctaaagttttcattcctaactggtggatctggggctactggatctcacccttgatgtatggatacaatgctctagctgttaatgaattctatgcccctcggtggatgaataagtttgtcctggaccaaaatggtgttcccaaaagactggggatagctatgcttgaaggtgccaacatctttgttgacaaaaactggtactggattggagcagcagggctcttgggtttcaccatcttcttcaatgtccttttcacactgtcgcttatgtacctgaaccctctcggcaagccacaagctgttatatcagaagaaactgcaaaggaagcggaaggcaacgggcattcaaaaggggcaataagaaatggaagcacaaaaccaaaggacggtagtcataacagtttggttatttcagaggaaatgaaggagatgaggttgagtgcatgtttgagcaactgttcatcaaatggggtttcacgactcatgtccattggcagcaatgaagctgctccaacaagaggaatggttcttccattcaaccctcttgctatgtcttttgataatgtgaactactatgttgacatgcctgcggaaatgaaacatcaaggagtgcaggatgacagactccaattgttgcgtgaggttacaggatcattcaggcctggagtgctgacagcacttatgggtgtcagtggagctggaaagactactcttatggatgttttggctggaagaaagactggggggtatattgaaggagacatcagaattgcaggctatcccaagaaccaagcaacattcgcaaggatttctggatactgcgagcaaaatgatatacattctcctcaggtcacagtaagggagtctttgatatactctgcctttttgcgccttcctggaaaaattggagatcaagaaataactgatgacataaagatgcaatttgtggatgaagttatggaactagtggagctcgacaatctgagggatgccttagttgggctaccaggaatcacagggctttcgacagagcaaagaaaaaggttgacaatagccgtggagctcgttgccaatccatcaatcatatttatggatgaaccaacatcagggcttgatgcaagagctgcagcaattgtcatgagaactgtgcggaacacagttgacactggacggacagttgtttgcacaatccatcagccaagcatcgacatctttgaatcttttgatgagttgctattgttgaaaagaggaggccaggtgatctactctgggaaattgggtcgcaactcccagaaaatggtggagtattttgaggcaattcctggagtgcctaaaataaaagataagtacaatcctgcaacgtggatgctcgaggtcagttcagttgcaactgaagtgcgactaaagatggattttgctaagtactatgaaacatcagatctgtataagcaaaacaaggtactggtgaaccagctgagtcaaccagagccaggaacatcagatctttatttccctacagagtactcgcaatccacaataggacagttcaaagcctgtctctggaagcaatggctgacttattggcgcagcccggattacaaccttgttagatattccttcactctgttagttgccttgcttctcggctccattttctggaggataggcaccaacatggaagatgcaaccactctcggtatggttattggagcaatgtacactgctgttatgtttatcggcatcaacaattgttcaactgtgcagccagttgtttcaattgaaagaacggtcttctacagagagagggctgctgggatgtactctgctatgccatatgccattgctcaggttgttatagagataccatatgtatttgtgcaaacaacgtactacaccctcattgtatacgccatgatgagcttccaatggacagctgtcaagttcttctggttcttcttcatttcctacttctccttcctctacttcacctactatggcatgatggctgtctcaatctccccaaaccatgaggttgcatccatcttcgcagcagctttcttttctctcttcaatctcttctcaggcttcttcattccgagaccgagaattcctggatggtggatctggtactactggatttgcccactggcatggacagtgtatgggctcatcgtgacacaatacggagacctggaagacctcatctcagtccctggagaaagtgagcagacgataagctactatgtaacacatcattttggataccacagggattttctgccggtcattgcgccggttctggtactctttgcagtattcttcgcgttcttgtacgcagtctgcatcaagaaactgaacttccagcaacga

SEQ ID NO: 64 - protein, 1570 aa, Zea mays
MESAMEKVWESGRRMSRSIGRGMGMGMETWGVDDAFVPQHGSRSRGGGGGGGDDDEEALRWAAIERLPTYSRVRTAILSTEAAAGVDDDDDKPRRPPPQQQQFKEVDVRKLGVGERQEFIERVFRVAEEDNQRFLQKLRNRIDRVGIELPTVEVRFERLTVEARCHVGSRALPTLLNTARNVAEAALGLCGVRLGGRQARLTILRDVSGAVRPSRMTLLLGPPSSGKTTLLLALAGKLDPALVVAGVGGGEVSYNGFRLGEFVPQKTAAYISQTDVHVGEMTVKETLDFSARCQGVGAKYDLMTELARREKGAGIRPEPEVDLFMKATSMEGVENSLQTDYTLRILGLDICADTIVGDQMQRGISGGQKKRVTTANDTVECHILRFVQKKKELCFCAVPLRSTHTRDTVPLIGTQQLVAYHLVVQGFQGEMIVGPTKVLFMDEISTGLDSSTTFQIVKCLQQIVHLGEATILMSLLQPAPETFDLFDDIILLSEGQIVYQGPREYVLEFFDSCGFCCPERKGTADFLQEVTSRKDQEQYWADKQMPYRYVSVPEFAQRFKRFHVGLQLENHLSLPFDKSRCHQAALVFSKHSVSTTELLKASFDKEWLLIKRNSFVYIFKTIQLIIVALIASTVFLRTHMHTTNLDDGFVYIGALLFTLIVNMFNGFAELSLTITRLPVFYKHRDLLFYPAWVFTVPNVILRIPFSIIESIVWVLVTYYTIGFAPDADRFFKHLLLVFLIQQMAGGLFRATAGLCRSMIIAQTGGALFLLIFFVLGGFVLPKVFIPNWWIWGYWISPLMYGYNALAVNEFYAPRWMNKFVLDQNGVPKRLGIAMLEGANIFVDKNWYWIGAAGLLGFTIFFNVLFTLSLMYLNPLGKPQAVISEETAKEAEGNGHSKGAIRNGSTKPKDGSHNSLVISEEMKEMRLSACLSNCSSNGVSRLMSIGSNEAAPTRGMVLPFNPLAMSFDNVNYYVDMPAEMKHQGVQDDRLQLLREVTGSFRPGVLTALMGVSGAGKTTLMDVLAGRKTGGYIEGDIRIAGYPKNQATFARISGYCEQNDIHSPQVTVRESLIYSAFLRLPGKIGDQEITDDIKMQFVDEVMELVELDNLRDALVGLPGITGLSTEQRKRLTIAVELVANPSIIFMDEPTSGLDARAAAIVMRTVRNTVDTGRTVVCTIHQPSIDIFESFDELLLLKRGGQVIYSGKLGRNSQKMVEYFEAIPGVPKIKDKYNPATWMLEVSSVATEVRLKMDFAKYYETSDLYKQNKVLVNQLSQPEPGTSDLYFPTEYSQSTIGQFKACLWKQWLTYWRSPDYNLVRYSFTLLVALLLGSIFWRIGTNMEDATTLGMVIGAMYTAVMFIGINNCSTVQPVVSIERTVFYRERAAGMYSAMPYAIAQVVIEIPYVFVQTTYYTLIVYAMMSFQWTAVKFFWFFFISYFSFLYFTYYGMMAVSISPNHEVASIFAAAFFSLFNLFSGFFIPRPRIPGWWIWYYWICPLAWTVYGLIVTQYGDLEDLISVPGESEQTISYYVTHHFGYHRDFLPVIAPVLVLFAVFFAFLYAVCIKKLNFQQR

SEQ ID NO: 65 - protein, 64 aa, Artificial Sequence
  consensus sequence for LEC-1 B domain
  VARIANT 5,6,18,19,22,33,45,47,51,54,55,56,57,61,62,63: Xaa= Any amino acid
REQDXXMPIANVIRIMRXXLPXHAKISDDAKEXIQECVSEYISFXTXEANXRCXXXXRKTXXXE

SEQ ID NO: 66 - DNA, 834 bp, Zea mays
  CDS (1)...(834): LEC1
atggactccagcagcttcctccctgccgccggcgcggagaatggctcggcggcgggcggcgccaacaatggcggcgctgctcagcagcatgcggcgccggcgatccgcgagcaggaccggctgatgccgatcgcgaacgtgatccgcatcatgcggcgcgtgctgccggcgcacgccaagatctcggacgacgccaaggagacgatccaggagtgcgtgtcggagtacatcagcttcatcacgggggaggccaacgagcggtgccagcgggagcagcgcaagaccatcaccgccgaggacgtgctgtgggccatgagccgcctcggcttcgacgactacgtcgagccgctcggcgcctacctccaccgctaccgcgagttcgagggcgacgcgcgcggcgtcgggctcgtcccgggggccgccccatcgcgcggcggcgaccaccacccgcactccatgtcgccagcggcgatgctcaagtcccgcgggccagtctccggagccgccatgctaccgcaccaccaccaccaccacgacatgcagatgcacgccgccatgtacgggggaacggccgtgcccccgccggccgggcctcctcaccacggcgggttcctcatgccacacccacagggtagtagccactacctgccttacgcgtacgagcccacgtacggcggtgagcacgccatggctgcatactatggaggcgccgcgtacgcgcccggcaacggcgggagcggcgacggcagtggcagtggcggcggtggcgggagcgcgtcgcacacaccgcagggcagcggcggcttggagcacccgcacccgttcgcgtacaag

SEQ ID NO: 67 - protein, 278 aa, Zea mays
MDSSSFLPAAGAENGSAAGGANNGGAAQQHAAPAIREQDRLMPIANVIRIMRRVLPAHAKISDDAKETIQECVSEYISFITGEANERCQREQRKTITAEDVLWAMSRLGFDDYVEPLGAYLHRYREFEGDARGVGLVPGAAPSRGGDHHPHSMSPAAMLKSRGPVSGAAMLPHHHHHHDMQMHAAMYGGTAVPPPAGPPHHGGFLMPHPQGSSHYLPYAYEPTYGGEHAMAAYYGGAAYAPGNGGSGDGSGSGGGGGSASHTPQGSGGLEHPHPFAYK

SEQ ID NO: 68 - DNA, 25 bp, Artificial Sequence
  BAC05 Forward Primer
cgagaaaagcctattgacttgagaa

SEQ ID NO: 69 - DNA, 25 bp, Artificial Sequence
  BAC05 Reverse Primer
ttgcatagccattccttacgtagtt

SEQ ID NO: 70 - DNA, 25 bp, Artificial Sequence
  BAC17 Forward Primer
cagattaacatgtcaatgcattacc

SEQ ID NO: 71 - DNA, 24 bp, Artificial Sequence
  BAC17 Reverse Primer
gcttgtaacccctttcctaacatg

SEQ ID NO: 72 - DNA, 27 bp, Artificial Sequence
  BAC18 Forward Primer
gcacttgtttgcaacaactactattgt

SEQ ID NO: 73 - DNA, 24 bp, Artificial Sequence
  BAC18 Reverse Primer
ggatcaacttttgaacgtggtgct

SEQ ID NO: 74 - DNA, 21 bp, Artificial Sequence
  BAC20 Forward Primer
tgtatgtgcttgcgcgttacg

SEQ ID NO: 75 - DNA, 22 bp, Artificial Sequence
  BAC20 Reverse Primer
caccctaggcaggagatggagt

SEQ ID NO: 76 - DNA, 27 bp, Artificial Sequence
  BAC22 Forward Primer
aactaggcatacggatttaaaatttcc

SEQ ID NO: 77 - DNA, 27 bp, Artificial Sequence
  BAC22 Reverse Primer
catgtccaagttcgtgtggtatttttc

SEQ ID NO: 78 - DNA, 25 bp, Artificial Sequence
  BAC24 Forward Primer
atcttaggactggtggaatgccaaa

SEQ ID NO: 79 - DNA, 28 bp, Artificial Sequence
  BAC24 Reverse Primer
ggctgacaaaaaatagactaattgtcag

SEQ ID NO: 80 - DNA, 25 bp, Artificial Sequence
  BAC29 Forward Primer
taacagtgggacggcaaagaactag

SEQ ID NO: 81 - DNA, 25 bp, Artificial Sequence
  BAC29 Reverse Primer
tgagctttccttgaccataacaagg

SEQ ID NO: 82 - DNA, 25 bp, Artificial Sequence
  BAC32 Forward Primer
tgaagatgtacacaaatgaattgcg

SEQ ID NO: 83 - DNA, 24 bp, Artificial Sequence
  BAC32 Reverse Primer
gtcaaatgtctccagcagattgtg

SEQ ID NO: 84 - DNA, 22 bp, Artificial Sequence
  QTL6SNP7 Forward Primer
tgacacgtcgccgtagcaacca

SEQ ID NO: 85 - DNA, 22 bp, Artificial Sequence
  QTL6SNP7 Reverse Primer
ttgaagctgccagggtcggtct

SEQ ID NO: 86 - DNA, 21 bp, Artificial Sequence
  QTL6SNP8 Forward Primer
ggctttgggggtgcgatactt

SEQ ID NO: 87 - DNA, 24 bp, Artificial Sequence
  QTL6SNP8 Reverse Primer
cggttcactctcgctcatgtaagt

SEQ ID NO: 88 - DNA, 26 bp, Artificial Sequence
  QTL6SNP9 Forward Primer
ccaccacacataactagactcgtctg

SEQ ID NO: 89 - DNA, 25 bp, Artificial Sequence
  QTL6SNP9 Reverse Primer
acactctgtttgaggtctgaggaaa

SEQ ID NO: 90 - DNA, 26 bp, Artificial Sequence
  QTL6SNP13 Forward Primer
ctcgcgttaaccacgcaacacaaaag

SEQ ID NO: 91 - DNA, 20 bp, Artificial Sequence
  QTL6SNP13 Reverse Primer
ggcgtggccgattcgattct

SEQ ID NO: 92 - DNA, 26 bp, Artificial Sequence
  QTL6SNP14 Forward Primer
ctgtcatggactaggtaaccaactcg

SEQ ID NO: 93 - DNA, 23 bp, Artificial Sequence
  QTL6SNP14 Reverse Primer
gcagcagatgtcgtcactgacag

SEQ ID NO: 94 - DNA, 21 bp, Artificial Sequence
  QTL6SNP15 Forward Primer
ccgcaacagctagtcagcaga

SEQ ID NO: 95 - DNA, 20 bp, Artificial Sequence
  QTL6SNP15 Reverse Primer
tgaggcggtacttgggctcg

SEQ ID NO: 96 - DNA, 24 bp, Artificial Sequence
  QTL6SNP16 Forward Primer
ttttgtgcactcggtacactgaag

SEQ ID NO: 97 - DNA, 24 bp, Artificial Sequence
  QTL6SNP16 Reverse Primer
caggacgtgtgtacgtactccgat

SEQ ID NO: 98 - DNA, 24 bp, Artificial Sequence
  QTL6SNP17 Forward Primer
cgggcctgtgatcctgctgctctt

SEQ ID NO: 99 - DNA, 20 bp, Artificial Sequence
  QTL6SNP17 Reverse Primer
cacgccgaagccgacgatgt

SEQ ID NO: 100 - DNA, 20 bp, Artificial Sequence
  MZA5002 Forward Primer
aagtcgcgcgagttcatggt

SEQ ID NO: 101 - DNA, 22 bp, Artificial Sequence
  MZA5002 Reverse Primer
ttattcctgcatcatcatccac

SEQ ID NO: 102 - DNA, 21 bp, Artificial Sequence
  MZA13321 Forward Primer
cagcaaggagctgagacaaat

SEQ ID NO: 103 - DNA, 21 bp, Artificial Sequence
  MZA13321 Reverse Primer
agcaaacaagtttttggtggc

SEQ ID NO: 104 - DNA, 18 bp, Artificial Sequence
  MZA15785 Forward Primer
cccagctcaacaaggacg

SEQ ID NO: 105 - DNA, 21 bp, Artificial Sequence
  MZA15785 Reverse Primer
ctgtatctgcaaaacgagaag

SEQ ID NO: 106 - DNA, 18 bp, Artificial Sequence
  MZA13118 Forward Primer
ggcgatgcagaaggtcgg

SEQ ID NO: 107 - DNA, 20 bp, Artificial Sequence
  MZA13118 Reverse Primer
taagctcatggatacaccgg

SEQ ID NO: 108 - DNA, 20 bp, Artificial Sequence
  MZA11771 Forward Primer
aggtcactgaaccaaatcag

SEQ ID NO: 109 - DNA, 20 bp, Artificial Sequence
  MZA11771 Reverse Primer
ggatatagactgaaagggaa

SEQ ID NO: 110 - DNA, 20 bp, Artificial Sequence
  MZA9351 Forward Primer
atgaccttgactctcccaag

SEQ ID NO: 111 - DNA, 22 bp, Artificial Sequence
  MZA9351 Reverse Primer
agatgcatacatactacatctg

SEQ ID NO: 112 - DNA, 21 bp, Artificial Sequence
  MZA8135 Forward Primer
ctgcgcatgttgtattctcat

SEQ ID NO: 113 - DNA, 21 bp, Artificial Sequence
  MZA8135 Reverse Primer
tcaacaaacagatggctgtgg

SEQ ID NO: 114 - DNA, 25 bp, Artificial Sequence
  DGAT1-2 ASK Forward Primer
ctggaaccttcctcgcatggccccg

SEQ ID NO: 115 - DNA, 28 bp, Artificial Sequence
  DGAT1-2 ASK Reverse Primer
ctatctacttgcctgggcctgcctgttc

SEQ ID NO: 116 - DNA, 263762 bp, Zea mays
  promoter (153888)...(156887): ZmPESP(Mo17)
  misc_feature (156888)...(165958): ZmPESP CDS (exon and intron sequences)
  3'UTR (165959)...(166382): ZmPESP(Mo17)
  promoter (173344)...(176343): Complementary strand for ZmDGAT1-2(Mo17) promoter
  misc_feature (167385)...(173343): Complementary strand for ZmDGAT1-2(Mo17) CDS (exon and intron sequences)
  3'UTR (167035)...(167384): Complementary strand for ZmDGAT1-2(Mo17) 3'UTR
  promoter (254826)...(257825): ZmABCT
  misc_feature (257826)...(263762): ZmABCT CDS (exon and intron sequences)
  misc_feature (1)...(263762): Genomic fragment
  misc_feature (10905)...(10944): n= A,T,C, or G
  misc_feature (11565)...(11648): n= A,T,C, or G
  misc_feature (11650)...(11689): n= A,T,C, or G
  misc_feature (13074)...(13113): n= A,T,C or G
  misc_feature (44721)...(44760): n= A,T,C, or G
  misc_feature (55538)...(55637): n= A,T,C or G
  misc_feature (56315)...(56380): n=A,T,C or G
  misc_feature (56387)...(56426): n=A,T,C or G
  misc_feature (63213)...(63252): n=A,T,C or G
  misc_feature (105020)...(105059): n=A,T,C or G
  misc_feature (142027)...(142047): n=A,T,C or G
  misc_feature (170752)...(170801): n=A,T,C or G
  misc_feature (197591)...(197640): n=A,T,C or G
  misc_feature (226035)...(226074): n=A,T,C or G
  misc_feature (237101)...(237140): n=A,T,C or G
  misc_feature (254421)...(254561): n=A,T,C or G
ccatacatctgacacggatgagtacagtgcaccgcgcagcacgggcgcactgtttcggcaacggactggacaggtgcgccatctgcagggtggccttggcgccgcctgccagcggaatggacaggacacaataaatgccgtgggggcacatcgcctgtcagaagggtggacatgcggcgtgtccttttcgcaataaatgcggaggtcgcgcggcccagagcccttacgtcatgctctgcccgctggcctacatcacggacaataagtcatgtggcagtattagaccctcgaccgagtggggagcggaggcgctccagatagagcctagacacgcgtcaataccggacccatgcctaggtcacggcacttcctcccccaggaccttgttatgggtggttcggagctcacttggtggggtccgaaccctatccaatggctccgggctgctttacttcgggggtccgggttgtgcgtacaggggtcccgtgccttctaggtccgacgacgttgtctccgagaacaccaccttaacttctcatgagatactcctggggctgtcctaagggtagccgcacaagcatcgtgccttcataccgtagcaaggggtacccctaatccagggtaccaacattatcattgaagtcagctaaatatagctgaccatctaacactcccttaaaagttattgaatcatcacttcttctaaagacaataacaccaacatcagtaaatagacagttgtagtccagtttacataattgagaaactgaaagcaagctgtaatctaaagaatctacaataaaatcatcagaaagggaatggtcaagagatatagaaattttacccaaacctttgaccaaaccttgatttccatccccgaatgtgattgctctttgggatcatcatttttctcatatgaggagaacatttttttctccgtgtcatatggtttgtgcacccgctatcgattatccaacttgttccgccggatgcataaacctacaacacatatttagaccttgttcttaggtacccaagcggtcttgggtccttttacattagaaacaagcacctttggtacccaaacacaagtctttgtgctcttgtctttacccccaacatatttgacaactactttgtctgatttgttagcaagcacaaatgatgcctaaaaagtcttaaatgaaatgctatgttcatttgatgcattaacaatcttttttaggaattttgatatgagttgtatgcctagagctagaagtctcattactgtaaataaaaagcatgatgagaaaacataatgagatttcttagcattaatttttctaatcttttgctcaggatagttttcaggatataaaatgtaaccttccgtaccttgaaccatgggagccttgcctttaacaaagttagaaagcttgtttctaggggcattaagtttgatgttgctttggctcccatgttggaagccagtaccatccttaatactagggcgtctcccattataaagcatattacgagcaaatttaaaattttcattctcaagttcatgctcggcaattttagcatttgatttaactatgtgatcattttattctttaatcatagtagcatgaatattaacatctctacatctagtgcaaattgtaacacgctcaatggtagatgtagaaacattgcaagcattcaattcttcgatcttatcaattaaactaacattttcagttttaagacaagaaattgaatcactacaaatattaagctcttaatcaagttttcacgtttttcaacttcaagggcataagtgagagcacctagaggggggtgaataggtgatcctgtaaaattcaatactaaatagccacaagcttggttataaagatgttagtgcaatagaaccaagtggctatagagcgagctcttgcgaatcacaataatcacagagaaagacaacacaagagacacaatggtttatctcgtggttcggccaagtataacacttgcctacctccacattgtggcgtcccaatggatgagggttacactcaacccctttcaagtgatccgatgatcaacttgaataccacggtattcttccttatagtgttctttccgattgcgaggaatctccacaagttggagcctctcgcccttacaagattgatctcaaagaaagcacagagtaaggttgggaagagcaacacacactagaattaaatccacaccgcaaacacgcacacaagtgagaagatgagcacacaaaacacacgcggggagtttacaactcaaaaaaatgctccaatctcaagaatgatgaacgattgcgtgaaagtgaggactagaagtcttggaatgcttagagtgtgcttcggtagctcctccatgcgcctaggggtcccttttatagccccaaggtagctaggagccgttggaggccaacaaggaaggccaaagttgccttctatggggtggcgcaccggatggtccggtgcaccaccggacaaccactgttcatgtccggtgcacgatctccttcctattctggagcagacgaccgttgcagattcgtggcagttggcacaccggacactgtccggtgccccctgccgactgttggcgcgggccacgcgtcgcccgcggattacgtgaccgaccgttgcgctggcggctgttggctctccggacagtccggtgcaccaccagacagtccggtgcaccaccagatagtccggtgaattatagccgtacgccgccaaattctcccgagagcggcttgttcaccggagtccagcctagcgcaccggacactgcccggtgcaccaccggacattccggtgtgccagactgagcagagatttggctgcaccgagccaagtcttttggttcttttttttctctatttctagcacttagacaacatatattagtactcaaaacaatgtactaagtctagaaacataccttgttacatgatttgcacttctctcttcatttgacacataataactcactcactatgtgttggtcacttaatcgccaaaatataatagaaatggcccaagggcacatttccctttcaataagcatcttttagcttagcaaattttttattttccttaacgagcaagtcttcttggcattcaaagatctcatccttctcgttaatggtctttattaactcattacttttcttcttttgttctgtggtgaggtttgcaaaagagaagataaatcatcatcattttcgctagtgttaccctcatcatcggaagtagtgtttttgggggtatctctagaatgtaccttcttcttcttgccatccttagccatgaggcattgtggccgacgttgtgaaagagaaggcccttgttaatggtgatgttggcagcgtcctcgtcggaggaggagtcggtggagctcttgtcggagtcccattctcaccctacatgcgcctcgccacccttcttcttgtagtatctcttcttctccatcttcttctttcctttcttttcgtcctcccttcccgagtctttgggattttcgccggtcatcatctcccttttggcttgttcttccgacatcacttcgagttgttagactctaatgaagcaccgagctctgataccgattaaaagtcgcctagagggggtgaataggcgaaacctgaaaattataaactttgaacacgcactatgcctggggttagtgatagaaataattcgaactacgaaagatagttctccttgctaggagttgctcaatcaatgcagataactttgggagccaactcaaatcaatatgagcaagggaactttagagagaggaagggaggggaaacaaatcgaatggagatcaacacaaatgaacacgacgatttgtttaccgaggttcggttccaaataacctagtccctgttgaggaggccacaaaggccgggtctatttcaaccctttccctctctcaatcgatcacacagatcggtcgagtgcttctccttaatcacttgggtcactaagaccccgtaaggatcaccacacacttaggtgtatcttgctagctttacaaagcaattagaagaattagaatgagaaggagagagcaatccaagcaacaaaagcaacaaaagaaacacaaaatacactctctcaagtcactaagcaattgggttgattttgaggcttggagaggatttgatcttttggatgtctcttggagtgaatgcttttgctcttatattgaatgtggagttcaaaaaacttggatgccttgaatggaggtggttgggggtatttatagccccaaccactattctagccactgttgtcgatggcacaccggatagtccggtgatgcaccggacatgacactgttcattgtccggtgcgtgccacgtcagttgcccgttggggtttggagcggttgactattgaagtcctttgtccttttgcggatcggacagtccggtggcacaccagacaatccagtgcgttctggctttgcagctctgacttccgacttctgcactatgcacttttcactattcgcacattcgaccgttggacgcagttgaccgttgctccgttggctcagcggacatgtctggtgcacaccagacagtccggtgaattatagcggagtgactcccagaaaaacccgagagcggccagttcgtgggtgccttggcctgggcatcgaacagtgtccggtgcgccactggcagccccaatgtttgtctttgctccaaacttccgttgagttcccaacttattttctttgttggtttatgttgaactttgtgcacctaagataaaagacaactatgcaaactagttagtccacgtggttgtgatggccatcaaacaccaaaatcgattataggaaatgtataagcccatttccctttcaaagttaaaatgccttatttggacggcctcatcggaatcgtaatcctcgtcgcccacctatggtacctgtgctccatactcaataatatcccatatgattttgtggagttaggttagatggtgcctcattttatcactccacatacaataatcttcaccatcgaaatatggtggtttgcctaggggaacggaaaagtagaggatcgcgtttagaaatacgagggtagcgaagggggatcttactatacttcttgtgctcttgacgcttagaagatgtagactcggcgctagaggttgagggtgaggaagaatcggtctcgtagtagaccacctttttcattttcttttttcttattgtcacccttcttatgtgacttgatggagccggcggattcctccttgtgcttcttgtgcttgtcgtcggcctccttccatagagtcctttgttcaatcttctttcccaaagatccgggcttttcctcggtgaccatatcccttttggcgtgttctcccaacatcacttcgagttgttagactctaatgaagtaccgggctctgataccaattgaaagtcgcctatatgtgggtgaataggcgaaacctaaaaattataaactttgaatacgaacttcacccgaggttaggattagaaataaatatggcgtgcataggatagttcttcttgctatgagttgctcaatcaatgcggatatctttgggagcaaactcaaaacaatgtgaacaagaacttttagtgagagggaagaaacaaatcgaatggtgaagatcaacacaaatggacatggcgatttgtttcccaaaggtttggttccaaagaacctactccacgttgaggaggccacaaaaggctgggtctattttaaccctttccctctttcaatcggccacctagactggttgagtgcttcttcttgacctatcgggtcacaaagaccctgcaaggatcaccacacaattaggtgtctcttgctagctttacaaatcacttagaaagtttagaaggagaagaagaaagcaaccaagtgaaagggaaatgtgcccttgggctatttctaatatattttggtgattaagtgcccaacacatattgagtgagtaattatgtgccaaatgatgaatgaagtgcaaatcaacaagaaggtatgattctagacttagtacattggtttttgtgtactaatatatttgtctaagtgctagaatcagagaaaagagaaagagtaaaggacttgactggaagcagccaagactcagctcggtctggcacaccggactgtccggtggtgcaccggacagtgttcggtgcgccaggccagctccgacgaactggccactctcgggaaatcttcagcggcgtacggctataattcaccggacagtccggtgagccaacggccgccagcgcaatggtcggccacgcaatccgcgcgcgacgcgtggccccagccaatggtcggctgggggcaccagactgtccggtgtgcaccagacagtgtctggtgcgccaatcagcccgaagatccaacggtcggttgcgccagaaatggaaggagatccgcaccggacatgctacagtggctgtccggtggtgcaccggactgtccggtgcgccacccgacagaaggcaagaattgcctttcttgttgggttccaacggctcctagctgccttggggctataaaagggacccctaggcgcatggaggatgtacccaagcattctttgatcatctcttagcaccaagactccattctcgcgcattcgattctttgagatagtgacttgagcaccatttgagtagagaactcctcgagttgtgttgtgagctcaagttgtggctttgtgtgcgtgattgtgcttgtgctttgagtcttgtgtgtgttgctcttcccacccttacttccgtgcttctttgtgatcatcaattgtaagggcgagaggctccaagttgtggagattcctcgcaaacgggaaagagtataagaaagaaaaatatcgtggtattcaagtcgatcattggatcacttgagaggggttgagtgcaaccctcgtccattgggacgccacaacgtggagtaggcaagtgttatacttgaccgaaccatgggataaatcactgtgtctcttgtgtttgttttctttgtgactattgtgtttcacaagagcttagtccttagccacttgattccattgtgctaacacttaaccaagttttgtggctacaagtatttgatttttacaggatcacctattcacccccctctaggtgctctcaattggtatcagagtcgttctcttcacaaaagggactaatcgcccgaagagatggatcctaagggaaaggggatggtggtcaacgacaagacaaaagagtccatcgtcaacgagccaagagatgataagccctcagactctggctcgagtcataagaaaagagatgggaagaagaagaggcgcatcaagaagatcgtctactacgacagcgatgagtcttcttcttccccaagagacgacgacgacgagaaaaagaaaccggttaactcaaacttttcttttgatttttctcgtattccgtttaactccaatgctcatttactttcaattccacttgggaaacctccgcactttgatggagaagactactcattttggagtcacaaaatgcgtagtcacctattctctctccatccaagtatttgggagattgttgaaaatagaatgctttttgatagtactgataaccccgttttcattaatgagcaaatccataaaaatgcacaagctaccactgttttgctagcatccttgtgcagggacaagtaccacaaggtgagcggcttggataacgccaaacaaatttgggacaccctcaagatttctcatgaggggaacgacgccaccatgatcaccaagatggagttggtggaaggtgaactgggaaggttcgcaatgatcaggggagaggagacaacacaaacgtacaacaggctcaagaccctagtcaacaaaatcaggagctatggaagcacgagatggacggaccacgacgtcgtccgacttatgctcaggtccttcactgttcttgatcctcatcttgtgaactcaatccgtgagaatcctaggtacacaaagatgacgcccgaagaaatacttggaaagtttgtaagcgggcgtatgatgatcaaggaagcaaaatacgttgatgaggcattgaatggcccaatgcccatctacgagcctcaaaccgttgctctcaaagcaacaagcagcagggaggcgctacctagcaaggtggcacaagttgaggcgattgggctaaacgaggatgagatggccctaatcataaagcgcttcaagaccgcattgaaaggacgcaaggagtactcaaacaagaacaaggcgaagggaaagcgctcctacttcaagtgcggtaagactggtcattttatagcaaagtgtcccgataactctagtgaccaggaacaaggaaagggcgggaagaaagagaagcaaaagagctataggaaggcaaagggcgaggcacacatcagaaaggaatgggactcggactgctcatcttctgattccgacgatgaaggactcgctgcttcagccttcaacaagtcctttctcttccccaacgaacgccacacctgcctcatggcaaaggagaaaaaggtaagcgtttgcgaaactcctaagtatactacttcaagcgatgatgaatctagtgatgatgaagtagactatactgaattatttaagggtttagatagatcaaaagtagataaaattaatgaattgattgatgccttaaatgagaaagatagactactagagaggcaagaagacattttgtatgaggaacatgacaagtttgttagtgttcaaaagtctcttgccttagaaataaagagaaatgaattactatcttctgagttatctacttgcaatgaaactgtggctagcttgaagagtattaatgatgatttaaatgccaagctagaagtagttaacaaatctagttcttgtgtagagaatgttgtaatttgcaatagatgcaaggattttaatgttgatgattgtgatgaacatttaatttccatttctaaattaaatgatgaagtagcaagtcttaatgctcaacttaagacttgcaaaagtgactttgataaattaaaattcgctagggatgcctacactattggtagacacccctcaattaaggatgggcttggctttcggaaggaagccaagaacttaacaagccaacgggctcccattctcaacaaggggaaagggaaggcccctatggctagtagcattcaaaagaatcatgcgttcatttatgatagaaaattttctaggaatgctcattataataggagttatgatgcttatgattctcatgctatgattgcttcaagttctacttttgtgcatggtagaagtaggcctagaaagggaaatgttattcatcatgtgcctaggaaaatgcataatgaatctgctactgttttccatgcctgcaacactgcttttgtactttcatgtaaaaataagaaagtggttgctaggaaattgggggccaaatgcaagggagacaagacttgcatttgggtcccaaaggatgttgtaactaaccttgtaggacccaacaagagttgggtacctaagacccaagcctaaaattgccttgcaggtttatgcatccgggggctcaagctggattatcggcagcggatgcacaaaccacatgatggggagaagaagatgttcacttcctacgtcaagagcaaagattctcaagattcgatcatctttggagatgggaaccaaggcaaggttaaaggtctaggaaagatagctatttcttccgagcattccatatctaatgtgttcttagttgaatcgctcgggtataacttgttgtccgttagtcaactatgtaacatgggctacaattgcttatttaccaatgtagatgtgtctgtttttagaaggaatgatggttcattagcttttaagggtgtactagatggcaaactctatttagttgatttttcgaaggaggaggctaatctagatgcatgcttaattgctaagactagcatgggctagttgtggcatcgccgtttagcacatgttgggatgaagaaccttcaaaaacttctaaagggagaacacgtgttaggtctaaccaatgtttctttcgaaaaagatagatcttgtgcagcttgtcaagcaggtaaacaggtgggaagtactcagcacagcaagaacgtgatgaccacgacaagacctctagagctacttcatatggacctcttcggacccgtcgcctaccttagcatcgagggaagtaagtatggtcttgttattgttgatgattttcccgcttcacttggatattttttgcaggataaattagaaacccaagggacccttaagcgcttcctaaggagagctcaaaatgaatttgagctcaaggtgaaaaagataaggagcgacgacgggtccgagttcaagaatcttcaagtggaggagtaccttgaggaggaaggaatcaagcacgagttctccgctccctacacaccacagcaaaacagtgtggtagagaggaagaacaggacacttatagacatggcaaggacgatgcttggagaattcaagacgtccgagcagttttggtcggaagctgtgaacacagcttgccacaccgtaaaccgggtctaccttcatcgcctcctcaagaagacgtcgtacgaacttctaaccggtaacaaacccaacgtctcatattttgtgtatttgggagcaaatgttacattcttgtgaagagaggtaggaatttcaaatttgctcccaaagctgtagaagggtttttgttaggttatgactcaaatacaaaggcgtatagagtcttcaaaaaataatcgagtttggttgaagtctctagcgacgttgtatttaggtaggnnnnnnnnnnnnnnnnnnnnnnnnnnnnnnnnnnnnnnnncatcgaagattggtgaagtctccaggcgaccttctatttgatgaaaataatggctctcccaagagagcaagttgattcttgatgatgtagatgaagatgatgttccaaccgatgcaattcgcaccctgcgatttggaaatgtgagaccataggaacacaaagagcaagatcaaccttcttcctcaataacgctgcacccctcaactcaagatgatgaacaggttcctcaagatgagacgtgtgatcaagggcgcgcacacgaagaccaagttgtggaagaagaagcatcacgggcccctcccactcaaatccgagcgacgattcaaaggaatcatcccgtcgaccagattttgggtgatataagcatgggagtaactactcgctctagattagctaatttttgtgagcattactcgtttgtctcttctattgagcctttcagggtagaagaggctttgctagatccagactgggtgttggctatgcaggaagagctcaataacttcaagcgaaatgaagtttggaccctggtgccacgtccaaagcaaaacgttgtgggaaccaagtgggtgttccgcaacaagcaagacgagcacggagtgagtgacaaggaacaaggcnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnngaactcattttgagcccatctcaagaatccctttaaggtctcttgggtatgagatttttcctgcaaaaagaacacccaagtgaagcgagaataatcatccacaataactagacagtacttactctcgtcgatgcttatgtaagctatcgggccgaatagatccatgtgtaggagctcgagtggcctgtcagtcgtcatgatgttcttgtgtggatgatgaacaccaacttgcttccctgcctgacatgcgctacaaatcctgtctttctcaaaatgaatatttgttagtcccaaaatatgttctccctttagaagcttgtgaaaattctttattccaacatgtgctagtcggcgataccagagccagcccatgttagtcttagcaattaagcaagtgtcgagtttagctctatcaaaatctactaagtacagctgaccctctaacactcccttaaatgctattgaatcatcacttcttctaaagacagtaacacctgtatctgtaaaaagacagttgtaacccattttacataattgcgaaactgaaagcaagttgtaatcaaaagaatctacaagaaaaacattggaaatggaatggtcaggtgatatagctattttacccaatcctttgaccaaaccttggtttccatccccgaatgtgatagctcgttggggatcttggtttttctcgtaggaggagaacatcttcttctcccctgtcatgtggtttgtgcacccgctgtcgatgatccaacttgagcccccggatgcataaacctacaaaacaaatttagttcttgattttaggtacccaaacggttttgggtcctttgacattagatacaagaactttgggtatccaaacacaagtttttgatcccttgtgtttgtcctcaacaaacttggcaactaccttgccggatttgttagtcaaaacataagatgcatcaaaagttttaaatgaaatgttggaatcatttgatgcactaggagttttcttcttaggcaatttagcatgggttgattgcctagagctagatgtctcacccttatacataaaagcatgattagggccagagtgagacttcctagaatgaattctcctaattttgctctctggataaccggcagggtacaaaatgtaaccctcgttatcctgaggcatgggagctttgcccttaacaaagttagacaatcttttaggaggggcattaagtttgacattgtctcccttttggaagccaatgtcatccttgatgccagggcgtctcccactatagagcatgcttctagcaaatttaaatttttcattttctaagtcatgctcattaattttagcatctaattttgctatatgatcattttgttgtttaattaaagctatnnnnnnnnnnnnnnnnnnnnnnnnnnnnnnnnnnnnnnnnctatgtgatcatgaatagcatcaatgttaacatctctacatctagtgcaaatagtgacatgctcaatggtagatgtagagggtttgcaagaattgagttcaacaatcttagcacgtaaaatatcattgttatctctaagatcggaaatggaagctttgcaaacttctaattctttagccttagcaatcaatttttcattttcaatcttaaggctagcaagagagacattcaattcttcaatcttagcaagcaagttaacattatcatctctaagattgggaattgaaatatcacaaatattagaatcaaccttagcaattagtttagcattttcatttctaaggttggcaatagtatcatgacaagtgcttagctcactagataatttttcacatttttctacttctagagcataagcattcttaaccttaacatgcttcttgttttctttaattaggaagtcctcttgagagtccaagagatcatccttctcatgaatagcactaattaattcatttagtttttccttttgttgcatgtttaggttggcaaaaagggtacgcaaattatcctcctcatcactacaattatcctcatcactagaggtttcatatttagtggaggattttgattttaccttcttccttttgccgtcttttgccatgaggcacttgtggccgacgttggggaagaggagtcccttggtgacggcgatgttggcggcgtcctcgtcggaggaagagtcggtggagctctcatcggagtcccattcacgacacatatgggcatcgccgcccttcttcttgtggtacctcttcttttctctcctcttgcccttcttgtcgtcgcccctgtcactatcactagataatagacatttagcaataaaatgaccgggcttaccacacttgtagcacactttcttggagcggggcttgtaatccttccccctcctttgcttgaggatttggcggaagctcttgatgatgagtgccatctcctcattgtcgagcttagaggcgtcgatgggttgtctacttgatgtagactcctctttcttctcctccgtcgccttgaatgcgactggttgtgcttcgggcgtggagggaccatctagctcgatgattttctttgatcctttgatcatcaactcaaagctcacaaaatttcctatcacttcctcaggagacattagtgtgtatctaggattaccatgaattaattgtacttgcgtagggttaagaaaaacaagtgatctaaggataaccttaaccatttcatggtcatcccattttgtgctctcgaggttgtgcacttggttcaccaaggtcttcaagcggttgtacatggcttgagggtcctcgccttggttgagtcggaaccgaccaagctccccctcgatcgtctcccgtttggtgattttggtcacctcatctccttcgtgcgcggtcttgagtacgtcccaaatctccttggcgctctttaatccttgcaccttgttatactcctctcgacttagagaggcgaggagtatagtggtggcttgagagttgaagggacggatttgggcgaccttgtccgaatcatagtcttcatcccccggtgatggtacctgtactccaatttcaacaacatcccaaatgctagtgtggagtgaggttaggtgatgcctcattttatcactccacatattataatcttcaccatcaaacataggtggtttgcctaatgggagggaaagtaaaggagtacgtttggaaatgcgagggtagcgtaggggaatcttactaaacttcttgcgctcatggcgcttagaagttacggacggcgtgtcggagccggaggtggatggcgacgaagagtcggtctcgtagtagaccaccttcctcatcttcttcttcttatcaccgctccgacgcgacttgtcgtgtgaaggggatcccttcaccttgttggcggactccccaaatggagctttcccatggcttgtgacgggcttctcgctggtcccgatctcccccttggcggatgctcccgacatcacttcgagcggttaggctctaatgaatcaccgggctctgataccaattgaaagacgcctagagagggggtgaatagggcgaatctgaaatttataaacttaagcacaactacaagccgggttagcgttagaaatataaacgagtccgagagagggggtgaaaatcaaatcgtaagcgaataaagagtgagacaaggatttgttttaccgaggttcggttcttgcaaacctactccccgttgaggtggtcacgaagaccgggtctctttcaaccctttccctctctcaaattgtcacttagaccgagtgagcttctcttctcaatcaaacggaacacaaagttcccgcaaggatcaccacacaattggtgtctcttgccttggttacaattgagtttgatcacaagaagaatgagaaagaaaagaagcaatccaagcgcaagagctcaaatgaacacaaatgtcactctctctagtcactatttgatttggagtgattccggacttgggagaggatttgatctctttggttgtgtctagaattgaatgctatagctcttgtaaggtgttgaaggtggaaaacttggatgcaattgaatgtggggtggttggggtatttatagccccaaccaccaaaaagaggtcgttggaaggctgctgtcgcatggcgcaccggatagtccggtgcgccaccggacactgtccggtgcgccagccacgtcatccggccgttagggttcgaccgttggagctctgactggtggggcctctgggctgtccggtggtgcaccggacaggtcctgtagactgtccggtgcgccaactgctcgtgttctgactctggcgcgcactatagcgcattgaatgcggttgcagtcaaccgttggcgcgaagtagccgttgttccgctggcacactggacagtccggtgcgacaccgaacactgtctggtgcttcaccgaacagtccggtgaattatagcggagcggcctcccattttcccgaaggtggcaagttcagctttgagttccctggtgcactggacactgtccagtggtgcactttgggatgtcttttgctctctttgtttgaaccctttcttggtctttttattggcttattgtgaacctttggcacctgtaaaacttatagactagagcaaactagttagtccaattatttgtgttgggcaattcaaccaccaaaatcaatttaggaaaaggtgtaagcctatttccctttcagggacccttcgacatcgtgtccaaagctcgaacgtggtttggtgacgacacatcttgttgcgggtcggcgttggactagcctgtcggtgtttagtgtccgaccacacacccagggatacccttgcggtgctttttgggtaggacagtgttgttgaatgtagctcaatggtccgtgctcggagcacgagagagaaagacatgtgattttctgtaggttcgggctgctttgagaggcgtagtaccctacttcctggggtggatctatatgtggtgtgttacaagaggcgtctcctgaatggagaggggctaataatatgagatgaaaaggatgggatcccctctgggccttatatacacgaccgtggggcactccttacgtacatgatgatcacatatctcctaactaatagcgaaccaactcaaccaatcttcccgaaaatctcgccgactcatccctgacccgccccgacattcgagggtgccaggcacgggaaagtcggacggtttctcaggatagcgcacgattcgacggactatctgagctcgagtccatcactttttcggtcgggcacattccgctagtagtcttcgcccggcccacgacgagatggcctttcaaggtaactggcctgaggccccgcgcaaggatctttcgccttctagtggacccgggggatatctgtcccccacatagcccctcccttacatcggctggattgacatggaacctggtcgtccgctccgcctcgtggagtttgctcgacaggaacttggtcgtccgctccgcctcgcggagttgcttggcagggacttggtcgtctgctccgccgagcagagtttgctcggcggagacttggtcacctgctctgcctcgtggagttgctcggctgggacttggtcggtgggcctgttttaaggagtttcttggggtttctttggacaccctgttctcgggtgcccgacaacgggcgagaccaaagtctacaattttgctttgaagtcaagttctaatacgatattgctggacttgacatatgtatgtgttatggttgtagataaatcgtagtgcatgtagctcagtcctatagttacatcaattgctattgacatactcattggctagtttaattgttcagttgtcagatctctccgatgcaaccaatcatatgccgcctgtttggttggcgtgcgcggtcgtgcactcgtaaccgcggagaattaaagcatggtttgtttggtttactttgctcagtgtactggctaagatgatgcaaactgaggggcgtggcgaggctccaggcacacgcagcctgcgagtgtacgcccatgtgcaggcactgctcgtgcaactgcacgcaaaccaaggctcttctttttatgttttcccattatatcttctagttaaaagatttaattaccaaaccgattttatattcgtttttctgggacttttgcgaataaaactatatcgcacatgttgtataagacttgaagatttatttatacactcttatcttaacacattctaatgcaggcaagcaaatacaagttatatcggccctagatgtacaaatgcaagcaaccaaacagaagtgggtctagcctgtgcacaaggagcctagctcctcgcgtacgagcgaggctacaactggacgacaatcgatcacatggataggctaccatgttccatgtattcatataccaggagctttgactcggaggctgatatgaagccaagcagattgaatgttagcatgcctgatggatccaagagtcccaatttcatcttgatactattttccagcatatcatccttctttaggcaattacctattttcttatcaactatcttgcagttgttaccgaggcatatcttgtatacctttcctgaaccaccactacccacaaggttattgtctgtaagaccataaagaatgtcttcaacattgtcattaatgggttggaaggttgttagcttaatagcttccaccgtggagatggggcctcaaccttcggccttgtgagggatgacctggtcttaatgaaacaaaaaaaccctgtgaatacgagaaatgttgaaccaagggtcaggggaatgattacaactcttttggacctggttgtctaatacacataggatagttgctcgtgcaaatttaggcatcctctaagactatcttcaatggtgccccctccccttgcacagtaccgaatttggaggctacagtgcaccggtatccacttcaacggtgccccctacatgtgctacagtagtgggggaatgcctagccgaccgccagatcaaggggcacgccaaacggccccttgccttgatatttgtgcacgccggtatttatcagtggtgaaaaaaatattaatagatgatgaatgtgtatggaaattgatattttatggttgtagtggggtataaaggaatggtatagggggaatcgctgcagagggaggagatatagagggagagagtgtgctcacgtggcgcggtagtgggatataggggtggaaatttagggggaaccgctgaagatagtctaagactgtgttcagcgtttccccctaaatttctccccctatatcctattcacatgacacgtcagcgttctcttcccccctatatctccacgctctacagcggttccccctaaatactctctctataccccactaccaccataaaatattgttttacctacttatacatcacccttatcaatatattttctactgaaaaacactgttgcgcacgttgatcgagggtaggggggcgactcgctccccctacatctggtgaagccctgtagcatacgctactactgtagcagctctggcgtcgtactgtgcacgctaaatcaagcggagggggcgtctcgcgggaaccgttgaagctagtctaatggctacccgagtggctccccctccccatattcacggtactgtttatctttgagtgcgtccaatgtttctgttagagtacccgctagggttttgggtatttcttgtgtaattaccctctcgcaccttctgtaatgagtctggtccaactatcaagtctattaatataattcccaacaccactccagagttagggtttcccacatggtatagaggctagtttctttcctccctcaaatcccatgttatctaaaatagtgatgtggcgcatgaaaatatcatgaagctaccattgtgaatagcctggatcgcgatccaaatgcttcttcacaaaatgttaaggctttaaataaaataaaattaaaaaatgaatagaaatagagctcgatcctaattcaattcaatccttagtgtgaaatttagcacccctagtcaccgatgaatacacaagagatagaaccgtagaccctatatggtcaacagtattagaggaggggtactcacggcaaccgttgaagagagtcttatggtacagttgctagattagcacaacaacaacatggattgggcttattcagctattgggtaatcgataactaacaaggatttcctaaaaaaggatgaagtgaacttactggtgccaccagtggtgcagcgtttttttaggctacacgggaatcctaaggtggtgtttgaatgcactagagataatagttagtggctaaaattagctagagacatccaaacatcctagctaataattcagctattagctatttttagtaaattagctactagttaacaaactatttgttagctagctaattctactagtatatttttagctaactaactattagctctagtgcattcaaacaccccctaaaccgctgcttgtttccaagaaagttccccagacgatcctgtttcacctatttcttctgaatgtcactgctgagtcaataaaaaaaaggaggtgcaatggtgaaaaacgcaacacgaaggaacttgacaagtagtacgtgagatggaatgctttgcttgggatccaaggcgaccagcatggtctgaagtgaatgtggttcttatctgttgcttttacgtacgtttttctcctaggaaagtgcccgttggttctaatcccatgttcggtttttttttccatgtccgtgccggcccacggatctgttcttactgcatcacggactccccccactttgaaaaaggtgtaagaagccgccgccgccgccccacccattggccttcctccctgggatagtgggatttgtgtggtctcaagttttctgaatccccaaagagtggccaaaagtttcagtctttcagtttcagaaaactgaaaagcgactcaacatcctgtatctgcaagctgcaccggtacaccatctacagcaaggcagctagttcgtgaattaaactggtttaggtaccgccggcgccggtcaaacactggatacatcatacacggcgtaattacacgcagtagtggcaggacgcgaaccaaagcacttcgtggtttgttcttgcgttgcgcccatgcggggtcgggcttcatcggccttctcgccgccgatcggtagaggccggcgcggcgcctctgcaaaattttcctgcttgcagcagccagacgcccagtagctagctatatactgtccgaaccgacagctacaccacgtgcgccacgaagtcgccgctgtcctcgtcgtcgtagctccaccggccggagccagacgtgctgcgtcgccggctgcctctcttccatgactcgacgaccggtgcgtctccgccgccgtagctcaccagctggcacgcctcggcctcagcggcgatctgttcgcaccggacgagctggtgcaggacctctttcatcgacggcctcgccagcgggctctcccccgtgcagatgacgccgagggtgaacaccgacaggatgtcttgcacgtcggccggctcccggatggcctcgtcgacgacgtcgtcgaacggcgcgcctttctggtaccgccgccacgcccactccgccaggcagaggtccgcgccgctgtcgttcgcgaccatgccggttgtgagctccagcaggacgacgccgaagctgtagacgtccaccttctcgttcacctttggcctgtacccatactctgcagagttcgttcgattgccacacatcaaccagctgcgaattctcgcagattttaattgaaaaatgactggcaactgaaatcctgagctgctaacctggagccatgtacccgaatgtcccgccgatggctgacacggactggggctcgccgggcctggcgaggatccgggcgagcccgaagtcggcgatcttggcctggaagtccgggtccagcaggatgttgctggacttgacgtcgcggtgcacgatcgggggcgcgcagtcgtggtgcatgtagctgagccccttggccgcgtcgacggcgatggcgagcctggtcggccagtccagcggcgccggcgccccctcccggtctcggcggtgcagccaccggtccaggctgccgttctccatgtactcgtacaccagcagcttggcttcctggctggagatgcagcacagcagcttcacgatgttgttgtgccggatgttgcccagcaccttcacctccgactcgaactccctgtccagcttctcgtcgcccttcctcgagttccatatcctcttcacggcgaccatcctcccgccgccgccctcctcgtcgcggctggcgccgttaccgctgccgagatggatccggtacacctttccggagccgccgctgccgatcacgttctcctcgcggatgttgccgagcacgtccgactcggagaagctgagctgggtaaaggccgtcatcttccagtccgtcgcctcctggctctccttccggtgccggaagagcagccaggcaatgccgatgctgccgccgaagacaatgacagcgagcaacacaaagaggatcatcaggcccttggaaagctcgtcgtggctgccccggcctccgcctgggcacgttgggaggttcgtgcctgagcccgccctggcgcagagccggttgccaaggaagctccggtcgtaggccgcactctgcagctgcgccggcacctcgccggtgagctggtttgatgacaagttaagcaagttgaacgcgttggttaggtctgatgggatggtgccggagagctcattgtcggacaggtcaagcatcgtcagtgctggaagaagcccgatgctcccctgcggtatcgcgccggtcagccggttgcctctcatgtcgagcgaattcagtttctgcagcagcttgatcgatgttgggatggagccagggatccggttgccgggcactgacagatcagtaaggttggcgagcttgctcatgtcagacggcaactcgccgcccagccggttgttctccgcatggagcaccttgagccctgctgccgaggccgggaaggagccggagaacatgttgttgcctatctcaatccgtgacagtttgggggatatctgggccggcagcgtgccagtgaagctgttgttctggatcatcaccaaggtcagatttgggaacgaccataccttctccgggaagtcgccggagaagttgttgttgtagagcatcaagttgtttaaagtgacgcagtccccgagcgccgcggggagctcgcccgagaagctgttgttgaaggcgacgatgtcgaagagcttgccgttagcgcagagcgaccctcgcagcgggccggagaggttgttaaggcacacctcgaggttgcccagcggcgagtgcttgcccagctccggcgggagctctccggacagctcgttctggaacaaccggatgtctctcagctgtggtagaagcccgatgctcaccgggatggtgcccgtgagctggttattgtatagaaacagcgttgtgaggttcttgagattgccgaagtcttgcggtatctctccggttagctgattcgacgacaaatcgatatgaaccaagttcaaggccgtcacgctgcgcgtcagctcgccagagaggacattgtggaacaggtagatgtactggagcttctgatgctgccacacccatgccgggatcgagccggtgaggttgttggaagccatgctaaatagagtgagctgttcgaggctagagaaggcctctgggatctctccggtgaggttcatgccatccatccagagaaatgtcaggttggtgagcttggagaactcggtgggcaccggcgccggcgcgaacgcgttgttggccagcgtgagcgtctggaggccggtgcggttgcttatctcggccgcagggtacgcgccagtgaagttgttggtgtcgagccgcagggaactgagcgccgggagccccgccaccgcgggcggcacctctccggagaagccgttggtggagaggttgaggtgctccatcgaccgcgagaggaggcggtcgatgtcgcgcgggagtggccccgagaactggttggtggagaggtcgaggaaggtgagcctcgcgcacgcgtacagcgcggcgccggggaaggcgcccgtgaggttgttgtaggagaggtcgaggtgggtgaggctcgcgagcgcgcacaccggtgccgggacggagcccgtgagtttctgcctggacaggataagctcggtgacgaccccaacgccgccggtggcgcacgtgacgccggtccagttgcagtggtcgggggcggcggcggggtcccaggacttgagctgcggggggctgccccaggccttcttgacggcgagcagcgtgtcgcggtcactggggccgccgccggcggcgggctgggagcggccctcgccggcgaggaggaagaggagcaagacgagcagcagggggaagcgatggcaggacgtggtgggccgcattttttgtttttgtccttggaagcttcctcggctgtgatgtgaggaggagatgagacgggacgggatcacgggactcgggcggagtgatgccgcgggagtgacggctggtgtccgagtttgtgcacggctctttatacgtgtgtgtgaaatgggtgtgcgagttgtggtcagcgtcaacggtctccgcctgctgttcggtggtccagtggcgcactcaaaagtgatggatgctaatcaactttgttctgtctgtctcttctgtaagaatcgagttcccaattcccatagtcaattagtcatagctcctacctcggttagtgtttcgtaaaaggattaaccctgtaatcgctgagtacaaataaactaatctcaccgactccctccacggtccatatcctaatgctagcgttgtttacactttactacaatactatcatgtcatataataaaataaatatagataaaacaacctttcttaacgaaaggctttcattatatagatttgtaaataatgaatttcatatcccataaatagataacaattactatgttataagaggtctgtaccataaaacttatcttgtttttaaaaatattaccccctcccctcccccccccccaccatcaaaatgcttattaactaccctctcccttctattatgtaagacataatcacataactagtatcatgtccgtgcgttgccacggtacatcaatcatatttgataaggtcactatatgcggtcagatcgcgcagccccgcgtgcgctcacgtgcacgccctcgtgaacggggatattctctcaccctttcagtttcttttttttcgttgttgtatataatatcaaatgctctcggtggtcccgcggcggctcctggctgtgggagctccacatcgtcatgtggaacgggccgagcgcccgtgctgcagaaagttttgcctgggccttgggatagagaaatacttttgttctgaattttctttttttttgcgagacaggttctgctcaaattacttccacggttccaccatcgtcaggtaggccgaccatttatgcacaatgataagcacttcaattaccgagccctcgtcttgttattttagagaaaattatttttggatacccgtcataaatatccctgcccgctgcactgcactgttctgccccgcatggccgcgggcgtgttagcgagcgccccagcgacgagggcgcttcgtttcttctggtcccagtcaacacagctcagctcagctcggctagcgagcacctcttgtctacacagtccccgacgcccacccgcccgcatcgctgcgactgcgagcgacgcaccgacccccttcgctggtccctgcctggccgccttcttccccctcccgtccgatcggtttcaccattcaccgtctgcgcgctccagccgccgcagtttgttgcgagcacacatcgcgagcgggatcagcgggcgcggagcggcgacggcggggggtgcgtgtaggagtggatgatggcgtggaggtgcgcgatggaggccgtgatgtgctcctcctagggtcgactgcgccgggtccgtgacgcgcccccatacctggagggcagtgacgttggaggggaatcgcagagtcgatgagggtgtggaggtgcacgataccgacaacgaggagcgattgggcgatgttcacagtggggaaatcgcgtgattgagggcagggacgtggaacctgagtcgccttcccctctccatccgcggctgggtcgctggagcgcgggcggggacaccatgcgggtgcatggcggctcggacggcctccgaaacggccggccacaccgtggctatgcggatgcgtggaggggaaggagaggcaagggcatggtgggtcgggcggcctccgagactgccgaccagaccgaggctgtgcggaggggaaggtgagtcggacggcctctccctccgagtcggggtcacaatgctgcacgcacgggtgaactggcggggccatatgacagtgacaacttggagtcggagggagaggtgaggcaggggcatggccgcgccaggcgcccacactgcactcttaattagtagtagggataagtagtatagaagtgagtgtaatctctctctatatatgtatatcttcaaagctttctaaaattactcgttttgaatcaaatcagcagcatgagcaactgcctggatgatgcctccgtttatatagcgcatgtgcatcacatttatttttatgatacaactagatatgtatccaaattctgtacatcaaaccgatgcacatctgaacattgtcgtttgggttcaccccactgatcatcaaactgataaaagagttgcatctagaaaccttaaaacccataaattttatcatcgtgtgattggtataagtgaatcaaacaaatctgtctagtttcactctgttatctcaagtcttagaaagacaagcacgatcatgcaccgtaagaacacgtgagtatccaaagtaacaattattcacatttacaaggaacacggcaacgaacaagcagtgaaaagtacaggatttcagcaactgggatggcaaccacttcacaagattcgacaacattcttccccgcctccgcgcacataatactcctggagtccaggccatggaacatgtgatccacacttcccatcttgcgcttcacgcacagcaggaagaagagctcaccatcctctcaggtggtctctggttgagaaccatcccgccttgtgggttctgaacctgctgccattgaagcagtttcttcgctgaaatgaggatgcaatagtgacagtgggtaaatgattgagcagcagcacactgtctgtgtgtttaaatgctagttactcaccaatctcatagaacacgtcgttcacattggtagctgttttggcagaagtttccatgaagaagagaccattctcttgagcgtacgcctttgcttcctgcagcataggataatgttacctaatgtattttgttttggttcagtagacaccatcacaatcaaacgagaggaagacaaaaaaacattgctgctatcatgcaccaacattttcatgctcccaggtgtgaatcatctaggcccctttggtaatgttttggtaattaatgacaactacttgtggactaacgattcttggagaaataagaatgcagggttggaccacatagaacaggaaatgttgaagagtcatacgcattggttgtggatcagatgaaggcaaaggtataatataggttttacttttgccggtcttgaggagtttagagaagatacctgaccggattagtaggctagatagccgtactattaagaggggtcaatgacttagatctgtgtaaaacttagtgcctcatagagcatcaagtagttgcatttgcatgaggactaacagcgcttctcatttcgtgagttaaaagttcattcaaaagcatgtttgagatttgagaagtcttggtcgcgcggactgtccggcccttgagggcggaccgtccgcaaccctccagagggtccgaagtcttaccatttgtgttgacactgtgttctattgtactgcggaccgtccgggccttagggccggaccgtccgcagtcctgaccaaaggaaggtggcttcgggtcagtccctgaattataggcggacggtccgcctgtgaggggcggacggtccgcatgtgtctaactcatttttggacagggactgtgtgtttttatagatttgtactacggacggtccgggggaccagtccggacagtactgtctcaggtcgcggacggtccgggatttatagccggacggtccgcgtgtgttaactccgtttgatccgaggctcgggtgtttgaatttgccaggtcgcggacggtccggccttgaagggcggactgtccggacccaccttttgagacagctctgacatgtttcaacggtcattatagctgttatgttgtacggcggaccgtccagccctagggcgcggacggtccgcgtgtgcgcagaattgcccccctttgcacataacggttggttttagatggagggctataaatagaagggtagctcgtgtgagagagctctcttggccattccttgcacacattgagctcatttgtgatcctccaactcactctctcacacgctttgcttgagattgcattccagtgagagattgagggttcctagtgcatttgcatcatttggtgattcttgaggcactaggtggtacaccgagcaagcgtcattggcttgttactcttggaggttgccgcctcctagacggctcgggtgattgtctccgtcgagctctccaagaagattgtggagaagccgtggtgttgattgtgaggggttcgcgcctacctcgccggagcggcaaaggtgacattagtggaatcgaggtattgagtgatttcttgtccacttggctcaaagatcaagtcgtgtcttgatagaggagcaagtgagagcttgaagtccacctcaacgtggattaggggtgatcggcaaatcaccgataccacgggataaatttcggtgtctattccttctagcattacttattgccttgcaattgattagtgttttgcttattgttcttcaagtattcaatctccgtagttgtctttcatacattgtttacttattgacactagtaaatttattcctcttgtcgtattgattaaatttacttagtattgttgtttttagtcaaaaccgtctattcaccccccctctagccggtgtcctagatcctacaccaggtcctagcttacacgagacatcaaactggaagtaatcactaaaaagacattctgtgttccctaccactctgaaacatattgttggccgataaagatgcagcgattgaatgcaaaagcttctaggatgagaaatcactaaagaatgaagatggcagcagctacataaacaaatgtggtagctcatgaatgtgttaaaaatagaacttgagaagcacattaacatacatctgctgacacctgcctcgtatctaacaaatcagccttgttcccagcaagagccactattgtattcgagtttcctacattaaaaaggaaaggaaaattaaaacaaaaacttgtagatcagcagcacactcaatgacataatacatccacagataaccccttccaaaaaaaatcacatcgtactcgctgaatcaacttcttacacagctcttcgataggactaaggtaaaaagtgcatgtattcaggggtctaagatccaaaatatcaatatctttacttttgaagcaaacttccaccatacaagtgcatgttctaatatgtagagcactgaggtaaaaagtgcaaagtagaactatgttaccttgtgcttgaagttcttgaacccatttcttcgcacgtgtaaaagaggcctataatgcataaaattaataatgagtactgctattcatatgtgcacaccacaatattagtaatttagtatgccttaagattaaaaggagaaaagaagattagattaaatttgttcatggagaaaatcagaataaatttaaggttgcttgatacataagacaagtcaaggttacctaagaaaaaaaagtagacaagctgttgagggtgatttgcattggagactgtagaattgacaacaactgaagtggccagcacacagaaacgatacagattattatccaccaatcgtgtggaattccggttctcctctgagcgactcctatgcttcgggttccgaagccactcctctatcaatttcacagttagacagtgtagattcttcgggaaggattctgctgctaactggccaaactcagctctctgaacaattgctgcctttgcacgctcctctagtgccagggcatggttcttcaatgtcactattgttgagctgatatcatagtgagagtcctgagccttgtatattaataatgctagccgacttattataggatgggcttcatctttagtgattgctctcccactaactgccccttcagagagcaatctttgacaattccttatctgcgaactaagctcccatgcaagctgaagattaccatgctcttttgcaaggatgacatacgcctttgctaaagtcatctgatccgctaattggcgagcaaataatgtgctgctcaaaagctcttctgagaaattcactttctcacgagggacttcctcgatctcaaccattatcctgaaataaatcaaaagaaaaacatgagaatatgcacaggggcaattttttcataactggaacagttacttttgcttacagcggaagcagccaatcaagttcgtacaaaagaaaacaaaggaagaaacctcaatctttgaactacagtctgtgagatgtgaaagtgttaacatttttaatttgagtagtccattctcatagcatcaatactattgaggtttttattttaaaatgatatttcctccaacatctttttccagtgaagaaaagtcatgtgaagctgccatttctgaagtagaatttaaattcatccaaaattaaccagataggtaacaggtttgcaaacctttgacaacaactaagtgcttggtgctatcttttattgaaagaaagcctataccataagctaaaatcaacaatggtctcatataccttggcagtatcctattctattcatgattcatcttatcgctctttggcatcttcaactctcaattgtgcagtttcaaaaggctcatcaaacaggtatcacaggtaggatttattgctataataagaaattcagtgaagcgattcaaatccatgccattaaaatattacaaattaagagagagagagagagagagaggcttaagtgttactgaaagttgcttgacgccaaaagaaacataaaaaagaaataatgaatgatggctgccaaatgccatacttttgggagtgttcagatacaacaagaaggccctaaataatcacttgaacttatcaaagtacaacatcacaatttacacatactactgaacattgacatataatacagattaggtcttctctgttacatgtccaccccagatgagaagaaagcatacacacgattgtttgttcaatagggcctgcccagccttcgggactgttctagtggccatagctaatgatttgcctcccaatcccagcttccaagaaggaccaaaagtgcaggaacgcaggaaatgggcggcagcagcacggacctggaggcggtggtccctgccgacaaacttgacgcagaatatgtgcaggacgtcgtcgagctggtcgaggcgctcggtggttttcgacgtgtgcaggccttgggttcctctccctcggcgacgtacaccaaaatatctgcacgtctcttaacagttaccacgaagagagaaacagaaagaagaccacgcaacaaccaaaaaaagaaaaatatcttgtgagcttagttacatagtcgacttgctctctaccaagcacacatcagcaagcaatcaaagccaagcatttgacaaaatgaagccactcccattgtgatctaagcgagcatcggacagtccaatcaattctaggtacatctaggctctgaaatttgaatcgtaaaggaagtcagccacagtcaatcagggaagataagtgacatcaatgcattcaattcgcttatggaataacaattgagatcagtgctcaaaggtaacatcaactcaattaccaacattaggagccaaggatcacactcatactacaacaaaacagcttgtcttttttatttatttcattcaccctatttcatataacataagttaaactaaaattcaatggcttaggtgggaagacttactaaaacatcccttagggtcagaactgccaagcatagtcccctgtccccagttgataaaaacaaatatcaaagtatgagtgttttccatcataccataaaacataatatggacaaccactgaaccacatagcaatctaagtgagtcctagaatacctggccaccagccaataaaacaatagccaacttcccctctgaaatggctctcaagcccctcctccaccacctttctttgtcctcaggagttctgtcgtcaactgtcgagacacttgactcaggaacaggctcaaaggttggtatatgagcacctgtacttgcattaaaacaccatcaaatatttgagcactcactgaaacttatactgcatattgaagcacgctaagagaaagctcaccttgtgatctaagcgagcatcggacagtccgatcaattctaggaagatctaggctctgaaattcgaatcgtaaaggaagtcagccacagtcaatcagggaagttcagtgacatcaatgcattcacttctcttatggaataacaattgagatcagtgctcaagggcaacatcaactcaattacctaaggatattcctgcaccggaggcgcaagagtctgcttcagctattcctgcacctgataaagcaccaaattacatgacaactaaacataaaaatgcaacagaaaggtttcacctgttacaaatcgtttacacgggtttccttgactaaactgtgcatacacctgtttataagagcacaaaacagcttacatacctttgtatttgtaccaatatatgcacaacttggtgaaacaatggatattatcatggttcaagcatgtcccaataataacaaatttctgttctgcagaattaatctcgaccagctcaaaaaaccaatcaattaacagtgtccagataaagcatcacgtgcacactcaagtagaaaacagcgcccagctatttcatatttttaagagagaattgtgcagcataagtgaatagtccacacatatacatcaccaaaattatcataacccaagcattttgcctattatttgtagaaaacagggagaattaaattctagtttttagagtcaatgccctacccacatgccagcagaaagatgttgcatgtattcttctaggtcttaagtcatcacatagacccagttttgcatatgcgatttcaaaagcagacatctttgacgaaaataatcatctcaggtcatccagaaaaatgagaagtcccatcataacacgacttgggaaaagatgcatgtcaaaaatagaaatggcacatgtactaaaatcacagaatagcagacatagatatgtaggtacaaaatacatcatgcattcatgttaaacaaaacattaatggtaacatcagcataaaaataagatcttcgaccttacaattcagacgtccgggtgtctgcatcagattgtatactggatgatttagtagccagtgaagagttgcttgctgtatcccccacattgttcactgaatccactacaatagtctcactatgtcgcattgtgttgctcgtcacattgttgtttgaacagtcaattggttctgaacttctgtcaacatcacaaacagctgagccaaatgtttttgtctctttgacaccacttgcggccacattttcactggctttctccaaagacgaagagtatcgatcaggtacagatgtggcttgtgtaacattaagtgcaggccgattcaatttcatgcaaagggctgaagttttcccacaggaatcattatttagttcactacaatcccaagaaccattagcagttttagtacccatgagggtttcttcacaaatatcaccttttaacacgatatgatcattttcttttgaaggaactgaagcagaatcaggaatgttgttattttgtagaattgattctgaggtacatttgcctgatgggttatgcacaaactgtgtgtctaaagaaggttcagggctttgaactattacaggtctattagatactgtgaccactgcatctgcagatttattagaaaggctgcttgttgtcaacaaagagccatttagagtgctacttaggccttctatcaccatgtatagatattccataatatacttaataattttgcctgtccaaaaataatgtgatcatatttacctgaagaacaacaataaggttctgaaacagtcatgtcgaccatttttagtgagccgttgtagtagttgatttacttacttgaagaccctcttcggttgcatctaccgcaacaattctgtaaaaacacatgaatatacaaaatatgaaaggtcatgagttatttcttcctttgctagaaaaaaggccaaacagttacaaggtgagaaagaattttctacaacacatgaaaattctctcataaatatatgtagcacagtccacaaatgcataagcaatgtgatccaacaattgtgtggagcaagtaaattagctggacaaaatactgaaatagggttaactgaccttaagctgctggaagcaaatggctttcagtgtcacattttttgccccataaatttgttttccctctcagcaagtttcagaatctggaatgagatggttcgttgtaacatcaacatagataacaatatctatgcaatatcaaggaacagtaaaatcaacgcacgataaggaaccaaaatgtattttgccttacaagaaataatatctttccaagagagaattgatacagatgcaataacaaaacaatcagcaaggtatttgtttagcaaggaataaaaaggtcaccaaaaatacaagacattgtcgaggtttgttttcagatgaaatgggaaccaaaattatggagagcttttcaaatggcttaaagcaaagtatgcctagaattttcttgtctttgctatttaagttctcacaagtttgaattctgagacagaaacatagcatcctcattcacgtactgatcaaagaaatggcatgtatacacatcaaggtactcatcgaagaagattagtctgagaccaacctctgatagacaaagagaaaaagagtgtccgttgatggttaacttctcacgtactactacttgctttgatctggcacagaactcaaatcaagcatgacatgactgaactctgacctacaaccaagcaaacaaattaaatccaatgaccagatttattgtaccagtgaaaagaaatggcagcttagcaagtattcatgtacgatcattttgcaagcactcatgtcaccttttcgcctcccccagatttccaggcactcatgtcactgaagcgtcgagaagggcgggtcacagatctggacgggcgaacgacctccagggttcagatccctttgactacgccacatgcccgacctcttctctgcgtcgggggacaacacgcttgtggccacgacgagcacctagagccaaggagtagagccatcagcgcataatcacagaagagatattcttgcaaccatgttctgatgatcatgagtcgatgaactcgctaatagatccaagaaaactggtgtcgggatcaagagatatagaatctggtggaaggaagggagggggaggtgcagtgctgacctggagttctagagcttaggggtggactttttctcgatgccaaggacaccgacaacgacttgcccttgtggatggctctagagggcataatcgacctggaagtggcggccgtggcggccacctccttgatccaacgcttcatcgtccatctcctgcagttgcacacgcgaggggtctcgctcactgggaatcgacacacgagttggagatctggagcgggtgcttgcttggagggggagacggggaacggtggagacgggggagcggcgcagagacggggagtggcgggcgcgtgcgcgacggttgcagccgagcgtggagcaccgctgggatgacgggtcagggccgaagatgtggtccccgctgacgaagtacccggtggagacctcgaggacggggacctcgtcgtcgaactcagagcgccgaaccttcaccgctgggcagatcgagcgcggataggaggttggggcagtggtgggagtaggataaggtgaaggaggcgtccatagcggaggcggtggcggcggagagaatccggatttcgagcgggcgtgctagcggctgggagcagagggagtgcgggttgtgcacctcagcagcgcggtccgcttgctgccgccgccggaccccccgcgcgtccgctctagcggtggctcgggctccgacccgcccgcgtcgctgtccccgagcccgccggcgtcctcctcgtagtccacctattggtcgtggcccagcgctgccgggaacgccgccaccccgccgaacctcatcctcctcctcgagctgctgtcgttgctgttgaagctgctggtgctgcaggagcaccatcgccctcgcgcctccaacctccggggcaggagcagggcctgggcggcaggatcgggcggttggcggcagtgaaatcggggaaggaagaaagagggtcgcgatgaatttggggtccgggcggcaggatcggggtgggatcgggcggctggtgggcgagatcgaatggttgaaaccgcagaacaatggattggacggttgaggttgcaggatggcagaacggcagaacggcaggaggcagactactcttacactcttaataagtagtaagactactctttaatctagtctcataatataacacgctctctctcataatataaggctgttatttatttattactccgtcctgcaagctaatctgatgcttggccataggaagctagggaccggaggcgatgccgattgccgagcacacagcagtgcatgtgcgtctcgatcagtcagtctcagtcgttgtctcgagtgtttgctgaccgagggaactcgcaagcccgacaccaccgatctagccaatcaggtagtagccgcaggcaacgacacaggagactagagaagactactgtatggccggaccccgggtactgccgctgccgccgattcatggatgggatgggagcaactgagcaagtcgatcgatcgccgcattctagaaccaagcacggaaaaaacattcaagtctcgctcgaaacacgacagcaaattaaacaggaaatggaagagtaacgaactacgtccactgctcctccatggaaaacccgtgaaacccttctttcttttttctttttgaaaactgaaatcccgtgaaactaacatcgcatgtatccatattactgtacttcacaaagacggaaatccagtctttcctctaggcttacctgaacgctcaaataccgtaaccaatgttttttttgtatttgtttatttttattttctagatcgacacggtagaaaaagcccctacatgatatattaggctttgacagccagggaaaaaacaccctaaggccttgttcgtttgtgtcggattgcatccggaattgttccaactaatcaaagtttgtataaattagagaagcaatccggttagaaaccgttccgacccaccaatccggcacaaacgaacaaggcctaagggatagccaggagtagagggctttggtttgaagccgcccggagtggtcagcggcgaagcagtgacgtttatcttgggagtcattgaggtaaatccgagagagcacgttctgcgtgaacaaaaagaaacttgagaggcctctatggggttcacgcagacaagaagcaagcccctactcaagaagatctgagaccataatggacttgtcctcctgtgcatgctcgaagattgaggggaaaagggtggctaagttatcgctgatgcaccggacatcaagccagaaggcggtgttgcgatcgtctaccacaacataggttgtgatggctcaatagagagggaggagtttcttgaggttgttccagtggtcaccccatagaggcctctcaagtttcacatgcatgtttggcctcgaacccagattgcccaggacgaggacgacgaggtgaagagcctgtgaagcatcttcaggagcaggtaggagttctgtgttaggatatttttgacccctagaccacctgattaccgctggctgtagacaacagaccaaggaactaagcatttgtcaccatttgcttgttcagagccagcctagaggaaaccccgtcgtttcctttcaatcctagcaaccgctgcaggggatagtcaaattgcacccataatgtagttgatttgaccatcaagatcagagttgagaaggacaaggcgacccatcgggttgagaagcttggattgccacccagcgaggtattgtttgttttgtcaatagtgggcatgaaggagtggagacagagtttgcagtttgaaagtggcaggcctaggtagctttgtgggaagcctatccgacggtagccaaaggcaaccacacagtccagagctaggtgatcatccaggtgcataggaaccatgacacttttggagttgtttatgaagagcccagtggctagagtgaactgatccagggtagacttaagggcttgtgcagcactaacataacctttgaggaggattagtgtgtcatcggcatactaaggatggtaggaggggtgtctgggacaatggggtgctcaatggacctatccattttgatcaaggctcaggtaaggtgaaaggggaccaccttgtctgaggcctttcttgcacgagaaccatgggctacgacatacatttaggacagcgaggtctttgaagtggataggagggagtgaacccaaccgcaccaacgtttagagaagtccctaacccttaggatggtgaggagagctgaccaattcatggtatcaaacacttttgtgaagtccagcttcacaactagagtgggcagcttcctcttatgacatcactgcacaagtttccatggcatggaaaaatgtttctaaactagtctgaccttttacaaatccaatctgatcagggtctatgagatttaagatctttgtctggagatgagaggtgatggcttttgagatgattttaacattacaattctagaggcaggttggtctaaaatccttcatctctgaggccccaatttttttgggaccagaactagaaaggatctattgatgcattctaaattttttttgcccaccgtagaaagccttcaacatggtaagcactctgtctttgatcgtgctctaggccactttatagaagctagggccaaaaccatcaggactgagagcagatagacttgacatggcaaagactgttgtcccggcctcttcttctatgaagatgtgatctgagcttaagccaaaagtagcttgcccccgataaagagcgttaacatcgaactaccagtgagcagggggacctaagttcgagttttggtggaagtagagggtggttgtagccatcatagagttgtggtctgaaagtgctgcgtctccatcctagatgaacttgatcgcatttcgctgacgacggtagcttgccacggcatgatgaaacaccgtgttggagtcaccatccatcacaacacgtactttacttccttgtttcaagtattctgccttctcgagcagcaaggtgaccaggcggtcatggcacatgcaacgcaggtcgtcctccgacatggaaaggaggtgaccctcttcatgccagtcgaagagcatgatgaggaacttgcaatcatcgatggtcactgagcggttcttgtgaacgcgtgcccacgctttagctctccggcaaacctgtttaaggtcaacagcgagacccctagctacatcacattcgatagcaatagagggcaagcccgaaaggatgcgggggtaggtaatcaaggttgtggagccaggcgttctcaaaacggtagatggatcgcattggggtggaagtggagagggttactagaagggggcgatggtcgaaggtggggcggggcttggtagttagggttgagggcctgtttggttcgtggctaactacgccacactttacctaaggttagtcgttcaaattgaagaactaatcttaggcagaaaagttaggcaaaatgtgtcaaattaggcagggaaccaaacatgccctaagtctataggtgcccaaacgggtggcccggcatggccccgcgggccgcagctccgacccagccacgccacgtcggcctagaaatgtatttttttgtttgtttgtttgcaagcgactcctctttttcaatgagattttacttagcaaaccagtccatttgtagttaggtccgggaacactagcttataaaccgtcactgtatctggagtttctgtactcacatgtgctcactttaaaattcctagctgaaaagaccaaggcctatccatcgtagatagatttaccactggcagcttcgtcgatctagttgttgaacaaaaagcagtcagttccaaccccttttcctcacgccacgccacgccacgccaccaactcccagttcggaagtcacagaaacggcacggcattggcgtccaattggcgggccagaaatcatatgaaagccagcaggtccccgcgcgtcaggaggattccgatccggcatgcccgcaagccggcgtcggtgattgatggtatggacgtatggtagtggtagcgccacagacggaaggcggtcgtggcggcacttgtggttgggttgggcaggaggcacgtcgagatagtgttcgattaacgatcaccgtctgcgcgcgcatggtgctgattgctgcatgcgtgttcggcaatgcaaaggtgtctgcttcgagtcctgtttctgttgaacatttagagcagctttgatttgattttctaaaagtaaaaaaaaaaaaatctgaccacggcacggagactgttttttggtggctatttgtcttttagtttatttttaattaaaacaccttaggtcctgcttttgtttttttgttttttgcttttctaaaataagtcggataaagaatttttcgtagttgtttaaaaaactaaagataagatgtactatattttacacttgttttgataaagcaggtttcagctttgaattttttatatgtatagcttatagtctgcattagctttttttccatacaaaatcctggtaatcattgctaccaccaagtgcagtgtattcagggactcaggccaacggcaagcgtttgcttgtacgactgatttccccggctttgaccagggtcagagtatgatctgctgcttgcgttcactcaccagtcattgcttgcgtaactgcgttagacatggggggtaggcactactaggcaagaaattaggcctccgatatggatttcaatcaggtcactaaggcctatctcctactaaaaatagttacttctgatgtctttaaactaattttgtgcggatcatggctgccaacgatagatcgctgaagattataattattgccggcggtcataaacctaactgctccaagtaaacgtattttcgatgaccagacctaagtcgctgcgcaaactaattttatgtggcctggtcctaaccatcgaaaataagattgttattcttggtaggtagccaaaaattcctatttgagccactaacttttgagtattcgaattcaggcaaggcatgaatattaaatgtctggattctcatatagattactatatccaagtagagcattaatccttgtaggatggacaaataccagaaaacatacatgccgtctagacagccctatagccagagatgtcaatggggaattccccaccgggttatagtatcacatacctaccccatcatgtttgatccatcctcatacccatccccatacccatcatgggtacaaaactcatctcatacccatccacattcgggtttcgggtccccaatgggtccacatccccaattaagggataactaggtactaacatgtagcacaaacaatctagatttcagacatcactacatcggcaagcactcatctatgaaccatgatccattcatccatccatcagaaaaaataagtacttcgggaccgtagaagaaatggagaaatgaagtttgctcacctttcttggtcaccatctgagttcgttggcgcctgagaatctatggtcgtcaccgtcgtctgggcagggtgtagcatatggctgattattttagagttttgttttttgctagtctaatagttgttgccttgtcgtgttgctagttgggctaggacctagggcatggtgcgctgccatgctaggcttggtggccggctcggcctcagctcattcatacaaacacgataggtgtacacgtatgaaatacccatgggtaatcaggttcggattattgcttcccaaacccatacccgtttacccaatgagtggagattttatctcatattcatacccattaagacaattttcgtcccatactcgtaccctaataggggaattccccacgggttggcgggtatcaggtcccgttgacatctctacctacagcttgagctgtgtttctggttattgagacccttctattcacaaagtgatatcaactctaggagttcatctgccgatcatgctcgaagtagagcaccaccggacgggggtagtaaagaacgatccgcaccgcaacaggagacaatgcaaaatctatggaccagaagacacacaagaaacagtcaaagatcttatattacagaaggaaagggcacaaaaggggacttagggtagagaacacaccaccgcatctagttctattctagacctagaacatggcagaagcatctcagacccaaacaagtcaactcagggaagcccgctgcagctcagttcatacacaagagtcagctgctcaacaagttaaaaaaaaacgaaaacttaaggttcatgctcatctagagtgtaccagcaagacatgacattcgaccatggccttccacaaaatcttcttcgtcgttttttttttgccatgccgttgtgcaagacatgatatccgataatctcccatcatccatcatcatagaaacccccgtaattgcgaatctgtgtccagaaggaaacttgtgagttgagctacttaccattccctccagcaagggggtagaacttatccatctctacaccattttttccccaatcttgtgtggttgatgccactaaccctgccataaagcagcacacaaataccaaacagccgagtataaagaaaacagggcaatgtagataccgaatgcacaagggatgagttcaagaccatgcctcagtgacgacttccacaatgtacacttgttcatacctgcatcagctcaagaaaccgcttcaatcctattgtttggctttatacatcaaaaaaacaatagtcgaaagagaatgttcagatcatgttagacagcgcataaacaggagaagggtgcaccagaagcatcacctctaactcttctggaaggccaccttgcgcaactccattcccgccaaaacgaacattttcagcaaggacatcctccttttccatactctccaacaattccgcactgttgttgctccccagcctttcacttccaactagctctgaaacaactttctcagctacgcgcttcaaagttgtgcacactgctacagtcggagtggtgcagttctcaacaagaggaacactactatgcttactaattgcatcaccagaacacactgctcctgttgtcgtgcacctaggggcagacagaatagtatctgggcttctctctgatgcctgaggtgaagccggactgccaccacttgcatcgctaggagccctttttatttggttgttacatctagtctcatcgccagtgcttccagattgaggtgaatttttcggatgaactgggctggtcgatgacctctttgcatacctgatatcatcagttccaacagaatcatgctttctcttcagttgactgtctggagacctggtcgctgtgccatcttcagtgtcatttttatcagactgatggttcacatgtcttgaagggcgaggtcttttataaccctctggaaacacataagctgggacctgcttcctacgaacatgagaaacagctaactccatcccaggcttccagaacatatacatgttgatttcatgcctgaactcatccaccgttcctcgaatatcgaactgttgtccttcctgtattttcacaccttctttccttgacaagcccatgaagaaagcacaatgagcacactgcctagaagggtctgcatattcatgtgggtaaggatgacactgtagcattccatatgtatcacgttcaatctgtttacaacagacaagaaaatagcttagttcagcacatgacaaattaacaacaacagcattaaaactagacaaaatcatgggattgattgatagaaacatagacactgtcttgataaaaaaaattatcttactaggggtgactaacaatcaaaatagcaactaaatcaaacaatgaaaaactaacagtggcttgccaacatgtttcctaccaccacctctgataccacaaaacgggcagcaaactagcaagttgactaagcttgtatgatgcaagatgcaactgatataacaaatgtgcacattaccttcaaagttagttgccgcaatcgagattcaacccatcctttccaaagcctaaggtcttcatcatcctcagcaatgatgtcaacttggnnnnnnnnnnnnnnnnnnnnnnnnnnnnnnnnnnnnnnnncttggcacagcattgggatagagctggcagacacgcgcaaccagtaaagcccagttgacaccaccaagaaagccagtaacctggcaaaacaaatgattggatatcataaaaagttgaagaggaagttagccaagcgtacttgtagcaaaaacttacattagagtaaacacctctcctttttgcccagtacttcaaacatcttaatgccgtgcgaaaattctgtaagaaaatacgcatagaattaaaacgttcagatactgtagaggaaacagacagttgagaaaacaaaacatgtgtatctgattcctcaagtcaacctcaaaatttggaacaagtctaatgatttggtctgctactctgcacccattaagactacggacagtagcttcatcaacatcataaagcactgatccttgggagatatccaagtcctgcagtagcacgttaactagatatgtatctctcggaataaaatggcataatacggcatgatgcaggacaaacatgtaaacctttatgcatacatttaaggacacaacaaagaaactaaagatttggcaaaatcaacagcagagggaattctgcattgatgtttgtaaaattaacctgtttgtcctaatgaatcaaggctgatggtgaagaacttgtatacaaatgcatctcaaagtcacaaaaatagtattgcaaaaaacgaagttcaggaatatctagaatgaaaagttcccactagatacctcactacagcagagaaacaaaagacagtgcaaccaggggtaacagaacgataaatgtataccatgatgactacaaaatagatagatagaaggcattctaacaaactttaaaagatagcaacaaaatcagatttttaccaggatacaagtaatttgcaatttaaaactgaagcgaaaggaagactgatttgatatggcaagcacaggcctgtacgatggaacctctgacattctacccatgctataaacacaaccaacacacctagtgagtcataggaattcctcaccaaatgcattgttctaaagtaggaacgacgcctgtagacataacaaaacactgccatgtaccatgttttatacaaagggatgtattctgtgtcacactaaaagaacagctgaaaataaaaatctttatgatactacaagttcaaacacctcatgaaataagctgtcgaagttgaacagttaaacaattgattaaatgggcaaaacatctagtaagaaacttacagctggtactactaagagggagacactggcataaagaaggtcaatagatattccatggaacttgaatttcataacagggacatgtgcatcaggtacaggctgcagctcggtcacatcctctgtttgtgctaatatcccatgcagtacaataaaaaaatcttcctgccaacaaatcatatgttagtaaagtcctgtctctaatacataaaccaccacaccgattgtgtaacataacagaacaaaaaaatcacctcacggttcacatatgaaggtccaacacagagggtatcaatatcagctccaggtccatgaacctacaaaggtgaaatacaaataaaaaacaaattattatgtgaaataagtactaagaatttttttcacaaagcaggattacagaaaaaaatgttcaggcccacgtaatttatatattttctacagacaaagccttgtaatcagaaaaaagggcagacccaatgccagaggaagggataaaccgacgttgcaaatacagaaaggctgcttcaaatccgtaacctggtgacacagtgggacagctctcaccactacaccaagcctgcccttctagccttgtgatgagaagcatcatgaaaatccaaatatcaaattacaatacaatcctgattttatacagagctagtccgatgacctaatcctgtttctacacacctataaaatcccaaaagatgtgtttgtgtggcctaatacttgttagaatcacaaggtcacaccagaactttaaatcacctattactggctatagaagctgttaccagcaattaatggtttgttaccacttgtcactatgtatctgacagcagcatgactacgtccaaaagattcagcttggatccagtttctaattgacagcaatgtgacacaacagagtgatatgaaatatggtcatcaaggtatctatacaaaccaggctagcggccaccagatatgagcatgaccattaaactcgaactatggccaatgatgaatgaggaacattgttgtgcaagaaccgaacatgcctcatctcaaccacatttccctatggaatgcatattctgaatttatacgttggcttaacaaggacaatgtttaggtcttcagaaactcaaatttattctcaaccagcacatgcttcatatcacaaggtagcatgacaagttgcagaacttcatgttaagttggatacttgtcggcaaatttacttttttaaaaatgtgactcttatctcattaaattgcgttctcaaaagagcaggtttggataaatgccatcactcctacaccacataaatcccacttcccaacatttagactgtttccatatcagttgtaacttgcaactagtcctcaagtacaagaaattccattgttgtgttttaatagggcacggacactgttaaaggagcatcaaatcaaaactatatagaaacacaattcaaaagtacaaagactatataaagtgtacacatcagtccatcacgattccactaatggatgaacaaaagatgggtgacagagcaaaagaggtgcagccagtaagagggaagtggtaaaaattaccccaagacggtatgagccaaaggtgaagagtacagcatttgcctcttcaaccatttgatcagtgtatcctctctgactagtcaattgttttacccagtcttttacaatctgcaaatgcccaaagaacatgcttagggaaggatagtgatgtgttgagcaaagtgacaaccatgggcatgttgtgcattaagaacacgtgtggcaacaaggaaagctacctggtcaagcttccccagcacctcctcccgcctagcagattcgtcagggctctcatagagacccgactcgagcaagaactgcgaatcaacaacataaaaactgtagctgtaacagatactacaatatcaatctgagacagaatgtgaaatcgtcaggcgcagaattgagacaatacttgtgggcatgaaactgaatcaattacaaaccttctctagctcctccgtcctctggaggtcggcctccaccggtccgagcaacgacaacggcttggttattccatactgcttcggggcatcagagccgctggccatggagccaacgacagaagaacacaaaaccctcctccgggacgcggcaaataaacgagcccccaacacgaggccgccctgacggaacagaatagcgtaactagcgcggatcggccgccggaaaccctgggaaaatcccggtaactcgcagccgcgccgccacaaaatcacagcttttatgcggagatcgagcgaggcacgacctctccccgggatcaacaccgcccgagtccgaaatttcccagacaacctgcccggactgcgccgccgggacgggtcggatcagatcaggccggactagccgcggccggagaggaccatccaatccagatctccctcccccgcgcggatccggagatccgccgcccgcgtaggcggggaagagagatacggaggtggcgcgtcggcggggtgggccgtagggcggcggcggggggagggcagcaggagagagggacggcgaataggtaaggggaaggtcgtagagagagaaaaggtagcgcgtgcgttctgtgggctatccgtccgtctatttcttcccaggaggacagtgaaggtagggaaaatatgagaggggttaatcggatatttggtcgtagagagagaaacggagtgttcgttgtgtatatgatcattttccttgagatgtgatataataatatctttttttcggttaacgcggagtcgcacagaaggggccggcccgtgttatccgttggcgccgcggcatgggcgacgcggaggagcagagaaacgcgccggaattggcgcggatggcgaggctgtgtggaagtagggatggcagttagaccgtgggtacgaatacccgatcaatatggatatcagtaaaaaaaatatccacgcgtcctttcggatcggatatcgaaatacattggatagtgtacgagtataatattttacccgtagtatccagtggatactcgagatatcaattcttaaatgggctatatttactaaaatttaaagcccatgaaaagatggagccaaaaaaccataactctcacccgaccacactatctctaattccattcatctcctgtcctctcgagtaccagctctatatttgagcaacctcaccgtaccaccgcaccctgccccgcccatgattcgacattgtgcgagtgtgcaaccacgtcgtccagccccgccgaggatctacatgcgtcaccctgcgccccagcccgcccaagcttcctccgactccggcgtctcgatcgatctccagcgtctcgcgctcgatcttcggctacccgtgaccctgactgcgccctccgatgatccttccaacttccctcagtgtccctttttcttcaagtttcctccgattagtcaaatattgtctttctcagtgttgcatagttgattagatgaaaacttaattattttaacatttattataacaataattaaatgttatgtagtctaaaaaacatatccaccggatatccgatacccgacggtacccggtgggtacggatacaggtacagtttctcgtccgattggcttggtggatatggatatttgtagaagactcgggggacaacatcgggtcaggtattactatacccaaacataatccgacctgctgccatccctaggtggaagggtaggtaaagtccgggcatgagtagtgggcgttcaactttggtcgatatggtcatatggactatcctggcgccagtgtaccagaacgaagtcgtacggtaagagatcatcaagtgactctccattttttactctttatttcactctttatttatctctccataaaaattacattttaaatagcatctaatcccaacatatcctctatttctcattctctaactacattctccacacaacgacatgtggggtacacatcatcccacacttggcaagtcagctagccaaatttgactaaagagggatccaattctcattctctaactacattctccacacaccgacatgtggggtacacatcatcccacacttggcaagtcagctagccaaatttgactaaagagggatccaatttagagagtcggatggttagtatgttattagaaagttattttggtgttaagtagccaaaatttaacttgacgagctatttaactagtctcttggaaatgctctaatgggtgttctgtttttgtagttttttttaccgggaacagatcgagttcataatagtcggaaatgaaaacggggcaaaatgaacaagtatacaaaaacaaagggaatattaagtgaaaaaacatattttaatatatatacctcttttactatataatatcaccaccgtcatcaactcttgcaaaaaaacttatatttcttcgtaatcaaccatggtccaagaccttgtgagcctaggcccggccaaccaacaacccagtcgggaaaccctagccatgctccccatctccataagtcccccccacgcttcctcttggtcccaactccccactccagcttctggtgctcccagccttgggcctctccgccgcatccgccgatacactatgacactcacgtcctcgggccttttgtatcgcgtctcagttgtcgtccgaaactgagagcacctagaggggggtgaataagtgatcctgtaaaaacttgaaacttaaagccacaaagttgattaagtgttagtacaatgaaatcaagtggctaaagagagctcttgtgaaccacaattgacacagtgagaacaagcacaagagacacaaggatttatcccgtggttcggccaagtacaatacttgcctagtccacgttgtggcgtcccaatggatgagagttgcactcaactcctttcaagtaatccaatgatcaacttgaataccacgatgttcttctttctttactctttcccgtatgcgaggaatctccacaacttggagcctctcgcccttacaatgagatgatcacaaagaagcacaaatgtaagaatgggaagagcaacacacacaagcctcaaagcacgaacacaaacacgcacacaagtcacagcttgagctctaagatcacacacggagttctcaactcaagaggagctcaaattgctatcacaacgaatcaaatgttctagagagatgtcttggtgctaagagatgatcaaataatgcttggtattctccttcatgcgcctaggggtcccttttatagccccaaggcatctaggagccgtttagagcaatcgaggaaggcaaaacttaccttctgtcgactggtgcaccggacagtccggtgcaccaccggacactgtccgatgcagatttctttcctattctggcgcagccgaccgttgaagatttggagccattggcgcaccggacactgtccggtgcacaccggacagtccggtgcccccatcagaccgttggcttggccacgcgtcacgcgcggattgcgcggccgaccgttggctcaccggacagtctggtgcaccaccggacagtccggtgatttatagccgtacaccgccgtcgagacccgagagtagccagttgaccagcgccaacctggcgcaccggacactgtccggtgcacccagactgaacagcaattggttgtacacaaccaactctttttccttttgtcttttctctgattctagcacttagacaaatatgttagtacacaaaaaccaatgtactaagtctagaatcatacctttgtgttgatatgcacttcttccacaatttggtatagtttcattcttaaaccatttgtgttggcacatgatcaccaaaatacttagaaatggcccaagggcacatttccctttcaatctccccctttttggtgatttatgccaacccaacaaaaagcaactaaaagaagtgcaacctcaatgcgaatgagtacacaaatttgttttgattcaaatttggtatatttggatcattctttgccaccatttggtttgtttttgcaaatcaaactcaattttctatctctaagtcaaattcacttagttgaggcatagagaaaggcattccaagagaaattgatcaaagattcaaaaactccccctttttcccataatcaaacattctccccactagagactaacttttgacaaaaagagacacttagagtattttgacaaaacagaagttctaactctactattttcaaaattctcaagtggtagctgatccatttcttgctttggccttattttctccccctttggcatcaagcaccaaaacgggatcaatattggcccttaaaccccattgcctcaccaaaatcttcaactcaaaataaaaggcaataagagtatggagatgaacttggagttaattaatctctaatcagagtgcagtggaagtctttcatggtccaagtccatctttccctttcaatccacctttgagactaaattaagcaagctcaaacacatagttagtctcaaagggtcaagttgtagcacatctccccctaaatatgtgtgtcacttgcaaatggacttgtgaggtccagggagtgcttgtacaacttgagcaccataaataaacaacaaaatgcataaggaacatgatcaaaggcataaaacacatgtatgttataaatcaatccaagttccgcgaatctaagacatttagctcactacgcagcctgcaaaaggtcttctcatctagaggcttggtaaagatatcggctagctggttctcggtgctaacataaaacacttcgatatgtcccttttgctggtggtctctcaaaaagtgatgccggatgtctatgtgcttagtgtggctgtgttcaacaggattatccgccatacggatagcactctcattatcacataggagtgggactttgctcagattgtagccaaagtcccggagggtttgcctcatccaaagtagttgcgcgcaacactgacctgcggcaacatactcagcctcagcggtgtatagggcaacagaagtttgtttcttagaactccaagacaccagggaccttcctaagaattagcacgtccctgatgtactcttcctatcaaccttacatccagcataatcggagtctgaatatccaattaagtcaaaggtagaccccttttgataccagatcccgaagcaaggcatagcgactaaatatctaagaattcgcttcacggccactaagtgacactcccttggatcggattgaaatctagcacacatgcatatactaagcataatatccggtctactagcacataagtaaagcaaggaacctatcatagaccggtatgctttttgatcaacagacttacctcctttgttgagatcgacgtatccgtcagttcccattggagtctttgcgggcttggtgtccttcatcccaacccgcttgatcaagtcttgcgtgtacttcgtttgggagatgaaagtctcgtccttgagttgcttcacttggaacccaaggaagtagttcaactcgcccatcatcgacatttcaaacttttgagtcatcaccctgctaaactcttcacaagacttttggttagtagaaccaaatattatgtcatcgacataaatttggcacacaaataaatcgccatcacacgtcttagtgaataaagttggatcagctttcccaaccttgaaagcattagcaattaaaaagtctctaaggcattcataccatgctcttggggcttgcttaagtccatagagcgtcttagagagcttacacacgtggtcggggtaccgttcatcctcaaagtcagggggttgctctacgtacacctcctccttgattggcccgttgaggaaagcgctcttcacatccatttggaacaacctgaaagaatggtgagcggcataggctaacaatatgcgaattggctctagcctagccacaggagcaaaagtctcctcaaagtccaaacctgcgacttgggcataaccttttgccacaagtcgtgccttgttccttgtcaccacctcgtgctcgtcctatttgttgcggaatacccacttggttcccacaacgttttgcttgggacgtggcaccaatgttcaaacttcatttcttttgaaattgttgagctcctcctgcatggccaacacccagtccggatctagcaaggcctcttctaccctgaaaggctcaatagaaaagacaaaagagtaatgctcacaaaaattaactaatctagagcgagtcgttactcccttgctaatatcatccaatatctggtcgacgggatgattcctttgaatcgttgctcgaatttgagttggaggggcatgttgtgcttcttcctccataacatgatcatcttgtgctcccccttgatcacatgcctcttcttgatgaacatgttcatcgtcttgagttgggggttgcaccattgttgaggaagaaggttgatcttgctccttttgttcctgtggccgcacatctccaattgacatggtgcgtattgcagtcgttggaacgtcttcttcgtctacatcatcaagatcaacaacttgctctcttggagagccattagtctcatcaaatacaatgtcgctagagacttcaaccaaacccgatgatttgttgaagaccctatacgcctttgtatttgagtcataacctaacaaaaacccttctacagctttgggagcaaacttagaatttctacctttcttcactagaatataacatttgctcccaaaaacacgaaagtatgatacattgggtttgttatcggttagcagttcgtacggcatcttcttgaggaggcgatgaaggtagacccggtttatggcgtggcaagccgtgttcacagcttccgaccaaaaccactcgggggtcttgaactctccaagcatcgtccttgccatgtcaatgagtgtcctgttcttcctctctaccacaccattttgctgtggtgtgtagggagcggagaactcgtgcttgattcatttctcctcgaggtactcctccacttgaaggttcttgaactaggacccgttgtcgctccttatcttcttcaccttgagctcaaactcattttgagctctccttaggaagcgcttgagggtcccttgggtttctgttttatcctgcaaaaagaatacccaagtgaagcgggaaaaatcatcaactataacaagaccatacttacttcctcctatgcttaggtaggcgacgggtccgaagaggtccatatgaagtaactccagaggtcttgatgtggtcattacattcttgttgtgatgagcacttcccacctgtttacctgcttgacaagctgcacaaggtctatctttttcgaaagtcacatttgttagtcctaacacatgttctccttttagaagtttgtgaaggttcttcatccccacatgtgccagacggcgatgccacagccagcccatgctagtcttagcaattaaacatgcatctagatcggcctcctccattgggnnnnnnnnnnnnnnnnnnnnnnnnnnnnnnnnnnnnnnnnatattacataattgactaacggacaacaagttatatccgagtgattctactaaaaacacattagaaatggaatgctcggatgaaattgctatttttctagtcctttaaccttgccttggttcccatcaccgaatatgattgaatctagggaatccttgttcttgacgtaggaggtgaacatcttcttctcccccgtcatgtggtttgtgcatccgctgtcgataatccagcttgagcccccagatgcataaacctgcaaggcaaatttaggcttgggtcttaggtacccaactcttgttgggtcctgcaaggttagtgacaatagccttagggacccaaatgcaagttttatctcccttgcattttgcccctaatttcctagcaatcactttcttatcctttctacaaattgcaaaggaagcattgcaagcatgataaattgtagaaggttcattacttgctttcctaggtacatgagcaacatttctcctaggcatatgatgaacaatagaagaactagaagcaggcatagcatatgaatcataagaattattcctataagcatttctagagaattttctatcactataaatgaaagcatgattcttttgaacactattggccataggggccttccctttctccttggcggagatggtagccttatgacttgttaagttcttggcttccctcttaaagccaagcccatccttaattgaggggtgtctaccaacaatnnnnnnnnnnnnnnnnnnnnnnnnnnnnnnnnnnnnnnnnnnnnnnnnnnnnnnnnnnnnnnnnnnatcgtannnnnnnnnnnnnnnnnnnnnnnnnnnnnnnnnnnnnnnngcacatcacagcaagaatgtgatgaccacttcaagacccctggagctgctgcatatggacctcttcggacccgtcgcctatctgagtataggaggaagtaagtatggtctagttattgttgatgacttttcccgcttcacttgggtgttctttttgcaggataagtctgaaacccaagggaccctcaagcgcttcctcaggagagctcaaaatgagtttgagctcaaagtgaagaagataaggagcgacaacgggtccgagttcaagaaccttcaagtggaagagtttcttgaggaggaagggatcaagcacgagttctccgctccctacacaccacagcaaaatggtgtggtagagaggaagaacaggacgctcatcgacatggcgaggacgatgctaggagagttcaagacccccgaatgtttttggacggaagccgtgaacacggcttgccacgccatcaacagggtctaccttcatcgactcctcaagaagacgtcgtatgagctactaaccggtaacaaacccaatgtatcttactttcgtgtatttggaagcaagtgctacattctagtgaagaagggtagaaattctaaatttgctcccaaagctgtagaagggtttttattaggttatgactcaaatacaaaggcgtatagagtcttcaacaaatcatcgggtttggttgaagtctctagcaacgttgtatttgatgagactaatggctctccaagagagcaagttgttgatcttgatgatgtagatgaagaagatgttccgacggccgctatacgaaccatggcgattggagaagttcggccacaggaacaagatgaacgagatcaaccttcttcctcaacaacggtgcatcccccaactcaagatgatgaacaggttcatcaacaggaggcgcgtgatcaagggggagcacaagatgatcatgtgatggaggaagaagcggaaccagcacctccaacccaagttcgagcaatgattcaaagggatcatcccgtcgaccaaattctgggtgacattagcaagggagtaactactcgatctcgattagttaatttttgtgagcactactcctttgtctcttctattgagcctttcagggtagaggaggccttgctagatccggactgggtgttggccatgcaggaggagctcaacaacttcaagaggaatgaagtttggacactggtgcctcgtccgaagcaaaatgttgtgggaaccaagtgggtgttccgcaacaaacaggatgagcacggggtggtgacgagaaacaaggctcgacttgtggcaaaaggttatgcccaagtcgcaggtttggatttcgaggagacttttgctcctgtggctaggctagaatcaattcgaatcttgctagcatatgccgctcatcattctttcaggttgtaccaaatggatgtgaagagcgctttcctcaacgggccaataaaggaggaggtgtacgtggagcaaccctctggcttcgaggatgaacggtaccccgaccatgtgtgtaagctctctaaggcgctctatggacttaagcaagccccaagagcatggtatgaatgccttagagactttctaattgttaattccttcaaggttgggaaagccgatccaactctttttacaaagacatgtgatggtgatttgtttgtgtgccaaatttatgtcgatgacataatatttggttctactaaccaaaagtcttgtgaagagtttagcagggtgatgacgcagaaattcgagatgtcgatgatgggcgagttgaactacttccttgggttccaagtgaagcaactcaaggaaggcaccttcatctcccaaacgaagtacacgcaagacttgctgaagcggtttgggatgaaggatgccaagcccgcaaagactccgatgggaaccgacggacacaccgacctcaacaaaggaggtaagtccgttgatcaaaaagcataccggtcaatgataggatctttgctttatttatgtgctagtagaccggatattatgcttagcgtatgcatgtgtgcaagatttcaatccgatcctaaggaatgtcacttagtggcagtgaagcgaatccttagatatttagttgctacgccttgcttcgggctctggtatccaaaggggtctacctttgacttggttggatactcagactccgactatgctggatgtaaggtcgataggaagagcacatcggggacgtgccaattcttaggaaggtccctggtgtcgtggaactctaagaaacaaacttccgttgccctatccaccgctgaggccgagtatgttgccgcaggacagtgttgcgcgcaactactttggatgaggcaaaccctcagggactttggctagaatctgagcaaagtcccactcctatgtgataatgagagtgctatccgcatggcggaaaatcctgttgagcacagccgcacaaagcacatagacatccggcatcactttttgagagaccaccagcaaaagggagatatcgaagtgtttcatgttagcaccgagaaccagctagccgatatctttaccaagcctctagatgagaagaccttttgcaggctgcgtagtgagctaaatgtcttagattcgcggaacttggattgaattgtagcatacacgtgtgtatgcctttgatcatgttcattctgcattttgttgtttattgaggtgctcaagttgtacaaacactcccaggacctcacaagtccgttgcaaagtgatgcacatgtttagggggagatgtgttacaacttgaccctttgagactaaccatatgcttgagtttgcttgatttagtctcgaaggaggattgaaagggaaaaggtggacttggaccatgaaagacttccactgcactccgatgagagggtaacttattccaagtccatctaatgaactcttattgccatttgctcttaattggagatttttggtgaggcaatggggttaaagggccaagattgatcccgttttggtgcttgatgccaaagggggagaaaataaaggccaaagcaataaatggatcagctaccacttgagaaattttgaaaatagtgaaatagagctttttgttttgtcaaaactctcttattgtctcttttgtcaaaagttggcttcttgtggggagaagtagtaattatgggaaaaagggggagttttttttaatctttgatcaatctcttttggaatgactctctttatgcttcaacatgtgtgtttgacttagagatagagatttgagttcgatttacaaaaacaaaccaagtggtggcaaaggatgatccatatatgccaaaattgaataaaactcaaatgtgttttatttgaagtgatattgcacttgttatagttgttttatgttgtgttggcataaatcaccaaaaatggggagattgaaagggaaatgtgcccttgggccatttctaagtattttggtgattgagtgtcaacacaagtgcttaaatgtgaaattatgcccatggatgaacaaagtgcaaatcatgagtaaaggtatgtttctaagccttagtacattggttttgagtactaatatatttgtctaagtgttagaaacagagagaagaagaaaagaagaatgttggctgtgtacagccaacaggctgtttcggtctggggcatcggactgtccggtggtgcaccggacagtgtccggtgcgccaggctgcctcgacctgaagacaccgctctcgggaatttgccgacggcgtacggctaaaagtcaccggactgtccggtgtgcaccgaactgtccggtgagccaacggtcggccgagccaacggtcggccgcggaatctacgcgcgacacgtggtctggccaacggtcggaaggaggcaccggactgtccggtgtgcaccggactgtccggtttgccagatctgcaacagtcggcaacggtcggctgcgccttgtaaggaaagaaatcaggcaccggacagtgtccggtgtgcaccggactgtccggtgcgcccgacgacagaaggcaaggatggccttccagatttgttctcaacggctcctagctgccttggggctataaaagggacccctaggcgcatggaggagaaaaccaagcattccttgagcactcttgatcactcacacatcaatcttgcgcacttgttcgacattctagtgatttgagctccgttctagtgtgctagtctcttgagctcaagtctgggtcttgtgtgtgcgtattcgctgtgatctttgtgtcgtgtgtgagttgctaatccctcccttgctccgtgattctctgtgaacatcttttgtaagggcgagaggctccaagttgtggagattcctcgcaaacgggattgagaaaagaaaagcaagaacaccgtggtattcaagttgatcattggatcacttgagaggagttgagtgcaactctcgtccgttgggacgccacaacgtggagtaggcaagttttgtacttggccgaaccacgggataaccaccgtgtcatctctgtgattgatttcttgtggttattgtgttttgactcctctctagccacttggccataattgtgctaacacttaacaagtttttgtggcttaagttttgaagttttacaggatcacctattcacccccccccctctaggtgctctcagtggccaagccaacggtctgatgggggcaccggactgtccggtgcgccaacggctccaaatcttcaatggtcggctgcgccagaataggaaagaaatctgcaccggacagtgtctggtggtgcaccagactgtccggtgcaccagtcgacagaaggcaagatttgccttcctggattgctctaaacggctcctagttgccttggggctattaaagggacccctaggtgcatgaaggagaataccaagcattctttgatcatctcttagcaccaagacatctctctagcgcatttgattcattgtgatagcaatttgagctcctcttgagttgagaactccttgtgtgatcttagagctcaagttgtgacttgtgtgcgtgtttgtgttcgtgctttgaggcttgtgtgtgttgctcttcccattcttacatatgtgcttctttgtgatcatctcattgtaagggcgagaggctccaagttgtggagattcctcgcaaacgggaaagagtaaagaaagaagaacattgtggtattcaagttgatcattggatcacttgaaaggagttgagtgcaactctcgtccattgggacgccacaacgtggactaggcaagtattgtacttggccgaaccacgggataaatccttgtgtctcttgtgcttgttctcactgtgtcaattgtggttcacaagagctctctttagccacttgatttcattgtactaacacttaatcaagtttgtggctttaagtttcaagtttttacaggatcacctattcaccccccctctaggtgctctcaattggtatcggagccgttctcttcacgaaagggactaatcgcccgaagagatggatcctaagggaaaggggatggtggtcaacgataaggagaaggagtccatcttcaacgagccgagggacgacaaagccactgactccggctcgagtcaaaagaagaaggacgggaagaagaagaggcggatcaagaagatagtctactacgacagcgacgagtcttcctcttcccaaaaggacgacgaatacaaggagaaaaagaaaacggttaactcgaacttttctttcgattattctcgtattccgcaaagttccaatgctcatttgctttccattccacttggtaaacctcctcactttgatggagaggactacggattttggagtcacaaaatgagtagtcacttgttctctctccatccaagtatatgggagatagtagaaaatggaatgcaatttaatagtacatatagtcccatatttatcaatgaacaaattcacaaaaatgcacaagctactactgtgttgttagcatcattgtgcagggaggaatatcataaggtgagcggcttggataacgccaagcagatttgggacaccctcaagatctcgcatgaggggaacgacgtcactatgctcaccaagatggagttggtggaaggcaaactaggaaggttcgcaatgatcaggggggaggagccaactcaaacttacaacaggctcaataccctggtcaacaaaataaggagctatggaagcacgagatggacggaccacgacgtcgtcaggcttatgctaaggtccttcaccatccttgatccgcatcttgtaaactctattcgtgaaaatcttacgtacaacaagatgacgcccgaagagatacttggaaagtttgtaagcgggcgaatgatgaccaaggagacgagatatgttgatgaggcgttaaatggcccaatccacgagcctcaaaccattgttctaaaagcaacaagtagcagggaggcactacctagcaaggtggcgcaagttgaggcggccgggctaaatgaagaggaaatggccctcatcatcaagcgattcaagacgacgctcaaaggtcgcaaggagcatcccaacaagagcaagacgaaggggaagcgctcctgcttcaagtgtggtaaggttggtcactttattgctaactgtcctgataatgatagtgaccaggatcaagaaaagaagagggaaaagaaaaagacttacaagaaagcgaagggcgaggcacaccttggcaaagagtgggactcggattgctcttcatccgacgatgaaggacnnnnnnnnnnnnnnnnnnnnnnnnnnnnnnnnnnnnnnnntaagtgagcttatacacgttattccccacagtttctgagcgatgaacatttatgaccttaccgttgcaatacctcccaggtgaagaacaggtaccaccagatgaagattactacgacgagatcagttgtcgtctctcagtcagcggttggcgttaaggaaataatattagttcgattcatttattatcaataattctgtaagacattttcgttatgtaataaagtttgtaacattcatctctatacactgagtcattatattatatgtgttgatcttgtttgacgtacatataagacgtatccgagtttgtcattaaaaatgagtgtgacaaaaaaagtgtcagtgacctcaaaaactataatttagaaacgaaataagggtatgcttaggtcccacccaactaaagttttgcttttagtccctaaacgaccaaacaacataactaaatgagacctccgaaataaaaattcgaaaaactaaaatttaacgactaaagcttagatggtgactgaaggaacgaacaccaaatgacctcacaatttgccttaccacaaatgcttccagtagtgtgggaaaagaagtgtgtaattacagatcatcatagggcagattcgacggacccaagcctcagttgaatttcaacatgcttgaagataaaaatctaaatttatgtcccgagggatgtctaacaaaagcagtttcacaccgggaccatatgaacaccctatgaaaacctgctccttcgtccactgctctaacaataaaatcagctgatgaagtacattgggtttggtagcttgaaggatctcgttgccatgggcgatcctatcaaatcactccactgatcccctgagttcccaagtatcttgaaaccttccgcttccattgctgctcgtctctctgatttgtactgcacagcgttcttgccaatatcataaggttgcctgcagcaagaatatgcttagattaataactgagctggctattgatatgcattgacctagtgattatgtaacttctaagtgcagatgtcctgaggaaaatctgcagtaacaaactacaaactgtgaagacaaaacatagaaattggtggcgaagcaggggttcttaatggttgcccttgtatctgagcaaaatatcctttagtaagaaatatacttttagctacagaaatatcaagattcacgaaaatataattttgacccttgaactcaaaaaccaaagacggcttcagctcccaaactaaaactcggccgggaagggaaagaccgtcctcccggtaatatattaacaagagaccgaaacaatggcctcgatcgagaaaatctccgaaccctggcccccatcactaacgggccgacgtcaaccatccaccctgcaacgacccaaccggagggtggcacacatgacattgtaacctgagagcggatggaacacaacgagaagatttttttaaccaagcctaaaaattcgcaccgaggggtatcaaacccagaacttgaagatgttactcggaagcccttaaccactaggctagatgctatttcgccttcagctctcaaacttgacatctttagatcttcagcctaatcaaaaaggtggtttactgctacacagtgctgaactgctgatatgagagcttttcgctgagtgccacacgcagtccatgtggcaaacttttcaaccttttctgttctgatttccaccacttagggcatgtttaggaggaaggaaaatgaaggggattcgaggggttaagatccccttgctattcaaaattgaatagcacggagattttagcccttctaatctcctttattctgctgacttccacacaagctcttaaaattttcttttccccccttttcctcactgagtcacacaccttggcttcgaggcatagtgccatcgatgggaatctaagtatctaaccccaataggaggcggccgaggcgtgagacaaactactaatatcacggggaactagcttgtgggcttcctcgttagtcggtactgggtaacatagaaggtggacagccacggtaggccagtgcaatgtggtgactgactcgacaacgcacttgtgactggaatagctcaagggcaggctagggagggaggtacaaggcaacgaggcagaatttctgacgcggtgaaaaaaaattaaggcgcatcaaaggaagagatcaagcagggcgacactaagtgcatgtcagccaaaaaaatgctgatgcggctgatgattctggcagctaaagcaggagttcggagatgtgaagggcactgattgtatagtgaatacaatcagaacatgatttaactactgattttgcaaaaggattgatgtcagagtaggatatggggatgaagtgaagggaggttttaggaggagcagagctcaccgctcaagattctggacagatctggccaagaaatatttgctccctgaaatcttgcttgcttgctttgaatatgtgccgcctgtattccaggacacaatcctcatactctcgcctctcggcctagtcctcagccagaccactgtcagcaacatgggcatgtcattagtacccaatacccatggcccttcatgtgtgcactgctgcaatgataatgatagcagcaaaccaccgttgagtgcctgggagtaggagagcagtgttgcaccaaagagggtggaaaaagggagatggggaagaagacactgtcattgactcaacgtggttggtgatatgccatagggatacatgtgggtacccaatgagtctttcctttctcttttcttgttttcaaaatctagactagttcattttgatgtgggttgaaccaattgcagtggcggacctaggatttgaacctagggtagttgaggacaaaaaaattgatatataatacaacatataatttggtaccatatatatctaatttccatccgctcgatacatgattattgattagaaattaacaaaaaaatgacatgtaatacatttaattcaacaaattcagttgatagttacatagatttatttcttttagcctaaatgctaatgagtagtttgtttttgtaccaaattctaggatagtcggaggcctatccaaaacactccttagctccgcccctgaccaattgccatagaaaagtaaacttgcatctctgatataggcaaaaccatggtgatgcggtgcaaatttgtgtagaatgagatcttaggcctaaagtgcaagatatcgataattcaatgaagttgtctgattttggagtttgacggccaaaatcgaattcaagcaatagttcaagggttagaatggactttttccttggtttttttatataattcaataaacattgacaatatatcattttcataaacagaattgtagaaaatacctcagtatgagtttttcccatgagttgtagccagcaaacaaaagattcaattctgtggcattacgttggaattcactccggccagtcaataggataacatggaaaccaagtccctgaagttgattgtacaaattcaagctcgatggtaatgttggtgcctttgcagcatctacccattcatcaaatgaggtctcattgaattcctgtgatctagaaaatcaggggaaatgtcaaaacaatacaacaaaattggacacataagtcaagtagagccagtttatgcattcattttttaagagcaacacaaaaaaatcaggtttacctcaactaaaaaaagatcaacgataccagagatgttctggagacaaaatctagcagcttccttttcttttgctcaataaacattgtgggttgtcccccaagttacaagcaaaaattcaatacaaggcacaagctgaccataagcccataaggtatacagaggatgccaattaatttggaccccataacagctttatacatgatacagttagctgcttctatttcctttcttagttaatttgtagtcccagaatcctaacaaagcataataagcagcaatgtgtttacaggcaaacaatcccaccgtacctagagtgctttgtgcgatattaatatttaacacatgacagagaatacctcagcattggcacattggtttggcaaaccaatgctaaaccacagtggtggagtattatcatgacccagagcaatgcttaaaagtctttaagtcgctgaatcgaacaaattcgcattgagttcagtttttgccacaactgattctaaataggggcggacccaagggtactctaggtacacccctcaactacaagtaatttggttcaaaaacatactactccttagaaattaggtccaaaacaaatttatgtaacttgtaacctaatttgatgaattaaatacatcatgactcatgagacattttggttgttttctgcttatatatatgaatcgatggaaattatatatatgtggtaccaaactacacatagtatcacatctcaaaaaaaaattctccactacccaagttgaaatcctggatcggccactgattctaagggtgtgtttagttgaggagtggatgagaacggtttttggatgtttggtttctaacaaaaaaaaaaaaagtgaggagcggctgctaaaatcttcacatgtaaatttactataaatagttgcaatactcctgctccaccaaaatgatcggaccgtaagcattcttttccctcttcttcactctacactcataactctctaaccaaacaaaaaaccaatcttcaatcagagaaaaaagcttgccaaacacaaaatataatgcctccattatcaaaaaatgatatggaactagttgactcttcaatcgcgtggcaaacggggacgcggtggctgcagtcaccttacccccatccgttgaccgcgtagtacggcgcgttagagagcagcgtctcgtcgacgtcgaacacccacgcaggcctcgcgctcgccgagccgccccactcggcggcggccagggcttcggaggcgaaggctagggcgtcggcgtcggcgacggcggagtcagacgcgtagcgaggtccctccatgtagtcccgcacgaaagccccacagcgcgagggcacggcgctccaggggcccgcgttggccgtctccaccgacagcctccagctgtcacagaagagcgcgtccgcggcgtctgccgcgccagaggagcccgcggtggggtcgtccgggaccgtgcggatgacagcgggcacggcggtcgctgatgcgatgagcgagagggcgaggagaaggcgctgggtcatgtcgccgacggcggcgccctgggtcctcccgtgcattttgtgggttgtggacttgtggtcgacggcgagaggtagggcggggtcgagttaaaatattccggcagtggtgattggtgaactggtgatggctgcgacttgcgagttgctactgctcgatcacgtgggagtgggaccttgcgggtcggaagtgatactgtgacgaacagctaggccccgtaggtgactgggcaagcttgtcactgaatttctgttgggtagttcagtgggacaaactacgaagtgaacggatctgcacgttacggtttgggtcattgcctcttaggcgcacactttcgtttttatttgaaaaaagctacaacaaacatataggaaatattttgatttttaagtattacttttgatatctatctatctatctaaaaaataaaataccttgtaaactagaacaaataaagtatgtattcttgtgttgacatccttctaatctctactacttattaaggcggtaagggataggttgtcattccgtattctgctattcccattccgctctatcattccgtattctgtcattcccattccgccctccccacaaagctcattctcattcccagctgtcattccgtgttattccctctccccgcaaagctcattccaattcccggttgccattccatattctgtcattcccattccgcctctccgcactgtctttctcattccccctcccacaaagctcattctcattcacatgtacatcccacgcctagctaaaattaaattaaaaaaacacaaatatggtcccaatgggattcaaacccgcaatccctcaaacaaatatgcttgtagctaccactacacaacatgtgtgtttatgtcaatatttattacaataaaaatatctactacatctctctcaaatcccacctgctacccttgcacaatgtgtagtagtagataattatcaacgagattactgaattatatttttggacggagacagtagtatttaaagaagagacatgcatgcaatttctttggtttttataatattttcaacttaaattccttttttatatgtgtgacatttattcgccgtaatattttttccatggatctgacttgtaagtcatttttataaaccaacgccaaagatgaatccatgtttcttacttggaaatcccgaacaaacaccactggcaggaggcgctcgcgttggcgttgctcatcgacaacgagaagaagcttggtgactgccagttcgacctctggaagcagtcctacgtgtccgcatgcgccactgtgttcggcaagctccggcgcagccgccgcttggacgtggtccagagcggctgcaccgcgctgtccatcttcaaacagggggatctcatggtcgtccccaacgctggcgactctcgggttgttctaggcaccacacccgacgacggcgctgtcacatcgtccagctcatcatctatctgaagctcaacttgccacgtaagtcgctactggtcggtcatgaattcttgtgcgctgggacgacggctgttgctgacgttgtgtgagtgtcctcgaacaagatgtatgtagaggagtagcacatccggtggtgcaatgactaggtgtactacctcgctgatgagcctggggtgcacttcgtttggcagcccagccaagagtcatcggtactcgccatgtcgtgcgcgttcgacgactactatatcaaggtatgtggcatcatcttggcgccagaggtgacgcagaggaggaccaacagaaatgaccacttgccatcgtcagggtagttttttgtgccggcctgcctttaattctcttcacagacacatatacttgcctttttttgtttaagcaagcgtgtatggtggtgcgtacctgatgactgacaatgtacgagggaacttgtactggcaggtatggcacgtgctcttcaatgatgagaccatgcaaattgtggcatatatcgaagtctgcatgatactgatggttgcaatgtagtagtgaaacagctaaattaaaataacaaaatttatgtatgaccaggattacaaatggattatgaaacattttttaaacaatataagacacattttgtatataagttatcatgttattatatgttcccgttgcaacgcacgggtactcacctagttcatttttattaactttagttttattttaacaactttctttatgacttggaaggacaaacattctttcggcgtgctgaaaaggtccacccatctctccttttctattttctgtctaaatctctagcacttttttttggtatccccgtccgcttccatcctcggcacacaaaactctcggatctgtcgcagctccatgctctcatcgccctagattcctctgcgaactcgagctctgcctcctccattgcaacctccctaccccacccttggctgcacccccacttgctttcacctctccctatgcatccgctcggcctcgctactgactccttgcttgtcgccgttgaggacggcggctgcgaggctacgactcgaccgagaccgagcccaagcgggaaaggcagtcacgactcgcccaaggccatccctaagcgggacacacagtcacgactcgctcgaggccaaccttgggcgggagacgcagtcacgactcacccacggccaacctcggatggaagacgcagtcacgactcgcccgagtccttccccgggcaagagatgcagtcatgactctcacgagaccaccctatggtaggatagccaatcatgactcgttcgaggccaaccctgagcgagagacgcagtcccgacacgcccgaggccaacccttgacgggagacacagtcacaactcgcccgagaccaacctcagacgggggacacaatcacgactcgcctgaggccaacctcgggtggaagacgcagtcacgactcgcccgaggctaagcccgggcaggagacgcaatcacgacttctccgaggacaacctcgggcgggacaggtagtcacgactcgctcgaggccaccctaggcaggagatggagtcacgacacgcccgaggccatcctcgggcgggacatgcagtcacgactcgttctaggccaaccccggacaggagacgcagtcacgacccgcccgaggccatcctcaagtgtaacaggcagtcacaactcgcctaaggccaacctcgtgcgggagacacgataacggctcgcacaagaccaaccccgggtgagagacacggtcacaactcgctcgaggccaaccccagacaagcagtgtatttccgactcgcccgagggcatctcgagcgatgctccagtaataataggaataatttgtgcgatattggtaacgtttgccacacgaattttgcatgttgtagttatgtttgttgttccgtatttatgtttcatacatttttttactattgtcgtaacgcgcaagcacatacatatattgtttatgtgtaatttgtccgattgtatctcttaactaatatatataatttaaaaagtcaaatttatatttgtgtttctgatatttttttataataaatcaattttattaaaaatattgtttcatttatttcaacacttagttaatttaaaacatattttagtttctatttgtcacatctgtttattgatataacaaacttggataaacaacaaaagcagggtctagactgctttcaaattttgtcggtgttttggacccgcgaggaccctcaaccgactagtgaatttgacgctgcgtgtccctgcccagatggattgatgcaagatggaacacaagaggggggatgaggcttatattatattgcaccggggtgctcgtagtaggggttacaagcttcgcgagagagggtttggccttaaagtgagtcgtctgagttagcctcctccgcctctcttgggaaggccctgggcatccccttttatagatacaaggggatggtccagctgtacatatgggggtgtagctatgtgctaacgtggctggcaaagaagtgcttgagccctgtagaagcgtagctggcagtgcggccctgggtcctgctgacgtttctttgccttcgtagagagctgagaacaatcgacgtcatggacgcatgcagggaaccatcattacctgttgccggagtaatctagatgtgacatcggtcttgttccttcatagcctgaggcggctagctaggggtagggtaatgatgtatcccctgtagcgtaatcggtccgaggccgaggtcaagcgaggcggtgacttctcctgaagccgaggctgaggttgggcgaggttgtgactcctcccgaggccgaggctgaggtcgggcgaggtggggaccttctctcgaggccgaggctgaggctgaggcctagggtcgggcgaggcggggaccttctcccgacgccgaggctgaggctgaggcctggggtcgggcgagacggagaccttctcccgaggccgaggctgaggccaaggcctggggtcgggcgaggcggagctccctgttgcgcccgaggctgaactcgggagaggccgtgacttactgttgttagtcttaccctggtggttggcacaatagttggaacagggtgaatagtgatgttttcctgtcagaacgatcagtaaaggggcgaagtgactgcggtcatttcgaccttgccaactgaggcgcgcgtgtcaggataaggtgtcaggtgatcctcgcattaaatgcgcatgcgatacggtcggtggtaaggcaatttggccgaggttgctatacaacaaagtttgcccgagcttagcctcgggcgagccgggggtgcgcccactgcctgaggaggccctcgggcgaggcgtgaatccgtctgggactactgttcttgcctgaggccaggctcgggcgagacgagatcgtgtccgttggtagatgaggctttaactttgagctgtgcttactagtctttacggtctgttttgaagatgttttccagccatgcttaggagtattgggggtacccctaattatggtacccgacaatagcccccgagcctcaaagggagtgtaggcactcgcttggaggttctgccggattttttgcaaggggactagcctttctcggttatattttgttccgatgggtgcgcgcgagcgcacccgtcgggtgtagcccccgaggcctcggaggagtggtttgactcctctgaggtcttaattcttcttgtgattcctcggtcggccttgttgttccctcatgcggcctggccacagcccgggtgcatggtcaggctctgagtttttaagctggtttgtcgacgtggtcaacaatttggtcgtagcctggtgcgagagcagcctccgagcctctgcacggagcgagaggacgatcgaggaccgtctcggcttttttattgtacgccccttcgttgcctttccgtaaggaggaggggggaacgcgccatgttaccctcggtgggcgctgaacatggtgtttctagtgagttgctattgggtaatccgagcggacgcccgagccctgttcgataagggtcggctagtggcccagaggcgcgctccaaaagtacctgcaggtgatttgctggacccggacccattcgatagggtccgagggctcggtgcctcccttcgatgggattccattacaaaccgttcccgctggtctcggaaatgtcctagggtacctcgggagtgtagcccgagccttggccatgtaacggacgtacccagggtcatccctgactctgcatgttctggggcggctgtcgaatcccttcgaggggccagccttcaaaccactgatcagtaaagggctcggagcccgagtgctctggggcagtcgccgaaccccgtagggcacaaccttcgaacccctgattagtaggagggctcggggcccgtttcttttgttgtgaagggctccttcgaaatgtcccctttcccgatccctgcggagagagagaaagagagaggaaaggaagaaaggagatatttcgaaacagtgtggcgcaccttttttgagacagtcatcatgacgaaggcgaaacgacacctgcccgcctgctagaggagacgtgtgtcctgccagggagttaatgcgacgggacgggcgactcgcgggttatctgttgcgcgtgcgcgagtcgttcgaggaatggaacacgggtgcgtcgtctttatgctgtaggagagggctcccctaccgcttcaggggaggatgcgagcctgtaggtgggaccagggcctggttggtggttggaccgctgctttcgtacgtctgttgctgcaattactgctggtccacctatggtcataccaactgtcgtgtctatccccacggctgactgacccgtgaccgtcgcacttaattggcactgttgggtcatgcgcggggctgcctcgagtcgttgcactgattctatagtcccgagaagacgcggcattggcgcaagtggcggtgtggtttctttgcacgtggtaaccggtgcgccggttacatgacatgtgggccctgttctccatgccggaccgccggttgcaacgaaactgaaagggtgcacaaccgtggtgcggttgcacgcttcttgcgtggcggtccgccttttcgaccgctggtttcggcgaggatgagagagcgcttaaccgcggggcggttgcatgcttcgtgtgtggcggttcgccatcttcgcgtttcgggtcagtttgtatgacatgtgggacctagcccctgtgtcgtagggtgggaaccctggagcacgtcgggggagactgtgcccgtgatgctttgggacgcgagtggggagatctgcctttaaaaagggatcgatctcttgggcagtagccatgccttttctcttctcgcattcatcgcgtctttccatctttcgggcctccagatggggtgcaccggtgttgccttcttcttgctgctgttggagaagcacggcctcgtgggggttggcgctctttagtcatcgctcggcttcaaggattttcatcatgtagcctggctgcagttccccgctagtggtcacccagaatgatgaccatcagccttgtggtggagaagagtgagccgggctgtggcctccccctgcccttagcttcaaggatgttcatcatccatgcaggggaggagggcaagccgagttggggtcctgcctttcgcctaggctggcgacccgcttctccctccagcattcgggggagaagggcgttcaccagccttgcggaggaggcgaactgccacctgctgcctggtcggggtgtggctgtccgtccaccgcacgggcgacggtcacgccgtgcgcaggtcggccatgtccacggcccttcccgcgccaccggccacattgggggtcgtacaagatgtcgtacgccgcaggggcggtgtccgcgttcctggatgttcttgtcctcactcccgtagcgaggacgggagcgaggacctccttgtgcgcgctagggtggccgccattcgccggtgcggtgttggtgcgcaggtggccgctgttgtcggtgctgaggtggtggccgccacaggtgaggcttcccactgcagaggtggttgcctccgccgacaagaccgtcggtgccacctgtggccgaacctccggctctttggctttaatggcttgttctcgccccccgtagggggacgggggcgagggccttttcacagtagcatttgccctggggcaatcgctgctgttgtttagccgcccgaggcagaggtcgttgtcgctgctggtgcagtggtcgccggtgagccgcttggagtttgttatcttgcagcccttctggtgtgtaggtagttcattcctgtgggaatggagctagggtcccgtttgtaagggaatgtaatggtatttgcctgagagcaaaatataattgctttaagtactaagacatctgtcgcatgttgggaaaaccaccgagggtgctgccgacgtctaagtctatgtagcatagttatcctaagtatgtgtgtttgttttctgtggctgctgaggcctgaacatttgggcatttgagtataaagccgtgtttctttcctcttatttcgagcattaggacttgttcgtcggtagcagaatcacttatccgagcgtgagctacctttcgcgaaaggtgatgagtaaggtatccgtatcccggaggcgtaggagtcggctcggtcggccttgtcgttcgaggtctctcttgtcgtttttaggattatgctatcgatatagtcgaaagccacgaaagtcattttggtacaaaacttttccgaggaaaattttgacgcagagggggttccccctcttctagacctgagtcgaccgctcaggccgggacccttgcggagggcttggccgtggccatcggatatggtcggtccgcccaagccatggcctcacagcagcgtgcccgggctgaaggtatgttttgcctgctttgtgactttgttttagcttcattcttctcctcgtgtctgaagaatattgtccggctgtcttcagggtttgagacggctcttaatgagtccgtcaagaactgcaaggcgcttgcccaggcggctgagcagaaggaggccgacagcatggccatgtccgaggccatctcggccttctgctagacctttggcctcgacgacgtcccctcgggcagctccccccagagtcgcctgcgggccttgggcggccacgcgcgcatcagacttcgcggggcgctgcaccatggcgttaggcgggccttcgctgtccttgcttcccactacgacgtggatttggagcgggtcagcgagggctactgcttacccgacgaagaggaggccaccctagccaaggtccaaaggcttaatgcggctgtcaagggcccaggcacggcgttggcttccttttttgaggtggagatcctttcgcctgtgtcaccatttgaggccgggccagattccgccgcgggtaggaacaacgccgagggtgctgctcctccccctgccgacacctgagcctatggggaacagtttattctaagcctgtggggaacatttttagtgttagagtataaagctgcgtttctttcctcttgtttcgagcgttaggacttgttcggtagcagaatcacttatccgagcgcgagttacttttcgcggaaggtgatgagtgaggtatccgtatcccggaggcgtaggagtccctcggctcggtcggccttgccgttcaaggtctctctcgctcgtttttaggattccattatcgacatagtcgaaaggcacgaaagtcattttggtagaaaacttttccgaggaaaattttgaagtagagggggttctccccttctagcccccgagggagggtcggtttttgctgaggcaaggccgatcctcccttgacagttagactttttatttatacatgtaaagggaccgagatacatgaacgacttgaaacactttagggataaaagcgacgtagttgttcgatgttccaagctttgctgtagacctcgccttgatcgttggccagcttgtatgtcccgggcttcaaaattttggcgatgatgaacggcccttcccagggaggagtaagcttgtggcgccctcaggcgtcttgtcgtagcagaagcaccaaatctcccacttggaagcctcggggccgaacccttcgggcgtggtagcgtcgcaaagactgctgataccgcgccgagtgtagtaaggctacgtcctgagcctcttccagctggtccagtgaatcttctcggctggtctggttgttttggtcgtcgtatgcctttgtcctcggggaaccgtattctaagtccgtgggtaggacggcctcggccccatagactagaaaaaacggcgagaaacccgtggccccggctcggcgtcgtcctcagactccaaaccatcgaggatagctcttttatccaccgcttgccaaatttgttgaggttgttgtagatcctcggttttagtccttgcaaaatcatgccattggcacgctccacctgcccatttgtcattgggtgagctacggtggcccagtccacacggatgtggtggccttcgcagaagtctaggaactttttcctagtgaattgcgtgccattgttggtgataatggagtttgggatcccaaagcggtggatgatatttgtaaagaacgccaccgcctgctcggacccgatgctggttaagggtcggacttcgatccacttggagaattttttatggcgaccagcaggtgcgtgaagcccccgggtgccttctgcaagggaccgacgaggtccagaccccacacggcaaacgaccaagcgataggtattgtctgtagggcctgagcgggcaggttcgtccgtctcgcgttgaattgacaccctcagcagaagcgtacaatcctagtggcgtcagccactgcggttggccagtagaaaccttgtcggaaagcgtttcctacgagggctcgaggtgctgcatggtgaccgcaagccctcgagtgtatttcctgtaacggctcttgtccttgggcgacggatatgcgtcgctgaagaatgcctgaggggctacggtggtacaactctttttcatcacccagtaaaacgaacgacttggcgcaccgagccagttgccgagcttcggccttgtcgaggggcagctctcctcggaggagatattccaggtacggggcctgccagtttaggtttggtgtgaccccattctgctctatctcgacgcgcagggcctcaccctcggcggccgaggtctcctcgggttcgggtgcatcgttgagtttgatgaatggttgatatatgtccctggagaagacattcaagggaactgtcgttcatcccgaggctattttagccagctcatccgcggtctcgttgtaccgtcgagcaacatggttgagttctagcccatagaacttatcttccaagcgccgaactttgtcactgtaggcctccatttttcgatcgcggcagtgagagttcttcatgacttgatcaataacgagatgcgagtcgccacgagcgtcgaggtaccgaacccctagctcgacggcgatgcgcaacccattaactaaggcctcatattcggccacgttgtttgacgccggaaaatggaggtgtattacgtagcgcacatgtttctcgaggggtgagatgaagagcaagccagcacctgctccggttttcataagcgacccatcgaagtgcatggtccaaagttcggcttggattggagctgtcggcaattgggtgtgacccattcagccaggaagtctgccaagacttgggattttatggccttctgaggagcgaatgaaagtgtttcccccatgagttccactgcccattttgctatcctacccgaggcctctcggcactggatgatctctcccagggggaaggatgacaccacagtcactggatgagactcgaagtagtgtcgcagctttcgccgtgttagaatcactgcgtacagtagcttctggatttgcgggtagcagattttggtcttggatagcacctcgctgatgaagtagactggcctctggatgagcagtgcatgcccctcttctcgtctctcgactacgaccgtagcactgaccacctgagtggttgcggctacgtaaatcaagagggcttctcccgcagcggggggcaccaagatgggcgcattagtaagaagtgcctttaagtttccgagggcttcttcggcctcgggagtccaagtgaagcgctcggccttccttaagaggcggtacaagggcaatcctttctcgccaaggcgcgagatgaagcggcttagagcctcaaggcatcccatgaccctttgtactccttttaaatctttgatgggtcccatgttggtgatggccatgattttctccgggttggcctcgatgcctcgttcggagacgatgaaccctaggagcatgcctcagggaactccgaagacacacttctcgggattgagttttacgcccttcgctcttagtcacctgaatgttatatcaaggtcagagaggaggtcggaagctttccttgttttgacaacaatgtcatcgatgtaagcctcgaccgttctgccgatgtgctctccgaacacatggttcatgcacctttggtatgttgcacctgcattcctcaagccaaatggtatagtagtataacaatacatgccaaaaggtgtgataaaagaagttatgagctggtcggattctttcatcttgatttggtgatagcgtcaataggcatcgaggaaagacaggatttagcacccagcggtggagtccacaatttgatcgatgcgaggcagagggtagggaacctttggacatgctttatttaacccaatgtagtctacacacatcctccatttcccaccttctttctttacaagtacagggttagctaaccattcgggatggaatacttctttgatgaaccctgcgaccattagcttgtggaccttctcgcctatggctctacgcttttcttcatcaaaacggcgtaggtgctgtttcacgggtcgggcatggactcagatgtccagtgagtgctcggcgacatcccttggtatgcctggcatgtccgagggactccacgcaaaaatttcggcgtttgcccagagaaagtcgacgagcactgcttcctatttggggtcgagctcgaagccgatcctgactttcttgctggcgtcgttgctggggtcgagagagacagatttaaccgcctcggctggttcgaagttgccggcgtgccgcttcgcatcgggcgcctctttggagaggctatccaggtcggcgatgagggcttcggactcggcgatggcctcggcatactccacgcattctacgttgcactcgtaagcgtggtggtatgtggatccgatggtgatggttcccttggggccgggcatcttgagcttgaggtacgtgtagttggggacgaccatgaacttggcgtagcacggtcttcccaacaccgcgtgataggttcctcggaacccgactacctcgaaagtgagggtttccttttgaaagttggaggcagttctgaagcagacgggcaaattaagttgcccaaggggcaggacacgcttgccggggacaatcccgtgaaaaggtgctgcaccggcccggatcgtggacagatcgacccctaagagccctagggtctcgacgtagatgatgttgaggttgctgcctccgtccatgaggactttggagagcctagcgttgccgatgacagggtcgacgacaagcgggtaccttcctgggctcgatacgcagtcggggtggtcgccttagtcgaaggtaatgggtttgtcggaccagtctaggtagactggcgttgctacctttgtcgagcagacctcccggtgttcctgcttgctgtgtcgagccgaggcattcgctacttgcccatcgtagatcatgaagcagttgtggacctctaggaactcctcttccttgtctcccccttcttgttgttgccttggtccttgccacctttcgccgagggtccatccttattgaagtaacgttggagcatgtcgcactcttcaagggtgtgcttgacgggacccctgtgataggggcatgactccttgagcatcttgtcgaacacgctggcccctccgggaggcttccgagaattcctgtgctcggcagcagcgacgagatccgcgtcaacggcgttgcgttttgcttgcgccttcttcctggtcttcttcttcgtgccacgctgaacggacgcctcggggacgtcttccttctgccttccctaaggctgcttgtccttccggaagatggcttcgaccgcctcctgaccagaggcaaacttggtggctatgtccatcaattcgctcgccttggtgggtgtcttgcgtcccagtttgcttaccaggtcccggcaagtagtgccggcgaggaatgcttcgatgacgtctgagtcggtgatgttaggcaactcggtgcactgctttgaaaaccgctggatgtactctcgcagggattcctctggctgctggcggcagctccggagatcccacgagttcccaggacgcacgtacgtaccttggaaatttccagcgaaggccttgactaggtcgtcccagtcgaagatctgcgcaggaggcagatgctccagccaggctcgggcagcgtcggagaggaaaatggggaggttgcggatgatgaggttgtcgtcgtccgtccctcccaactggcatgccagccggtaatccgcaagccacaactctggcctcgtctcccctgagtacttggtaatggtagtcggggcctggaaccgggccgggaacagcgcccatcgtatggcccggctgacccatggacctagtggtttgggcgaggggctccgatcctcctcactgtcgtagcgtcctccgcgtctggggtggtagcctcggcgcaccctttcctcgaggcgggctcgatggtcgcgacggtgttgctcgtcgccgaggcgaccccgggctgcaggtgtcccgtctcctgtgtgctcggtgtggaccgaggcctcgcgcatgtgtcgggaggacgctgcgtgatgctccgaggggcatcctcgccttcgggaggcagagctctcggctcgtcgggctacgacattttctaggaggtccttgagttcgccctggatacgtcgcccctcggtggtggatggctccggcattgtttgaagtaacatcgccgttgcagctaggctctggccggccccgttgaaggccgggggcagccctgccctggcgtcgtcaattatacgtcgctggacgtcccgggcccgatgtcgcgctcctccggcgagtgctcgacctgcccactcttgctcgatgttttttcggagctgcacaagtcgccccgtttcttcgtcgagcttggcctgcatctcgcggagttgatcgagatgtgtgccctgaccccccgcagggacccgggctatagctagctcccgcgggatctcaacgcgagacgcaggcacaggggcgtcgtcgtttcctggcatgccgaggtggttgtcttcgttgtgatcccctgatcgatgtggaaacactcgtgagttgggtcgtaacccccgtcgtcaaggctgtggccatcgtcagagtagccggagaggcagtggtcacatgcggatatgaagtctcgcatggcactgggatcacggagtccggagaaatcccaactaaagtcggggtcgttctcttcctcggaacccgcgggtccggaggttgagacggccgtcaataggtcccaagttaaccacatatggtaccccggaagctcaggatatgcccttgcgaaagcgctcgccgaagtggggtcgcttggtggatcgaagctgaatctaaagagaacaggatggaaactgatggtacctcctggttgatggatggtggtgaagttgcatcggagatggaacgtgtcgttatctcaggtgcgagactaatgcccgacaagtccctcgcaagggtgctggcgtcatcagtccgcctggggttggcacgttgctgggaagcgacacccgtcgttgtcccaggtgcggggatgatacccgacatgtcccccgcaggggtgtcggcgtcgtcgactcgctctggtccgacagccgacgaggtgctgcctcctgcctggccatggttgctgcgtctcctcctcctccggcaaggtgggtggcggggcaaacccgggtgttcctcttctgccgtggggagatgtcgtcgtcgggttcgcctccgtcgggcgagccgacggccgccgttgttgtcgtgctgcggggggaggagtaccatgtcgtagctgccgtcgcgggacatgaactcgagactcccaaagcggagcaccgtcccgggctgaagaggctgctgaagattgtccatctggaactcaacgggaaagtattgccaacacgcagctggacccctacctggcgcgccaactgtcggcgttttggacccgcgaggaccctcaaccgactagtgaatttgacgctgcgtgtccctgcccaaatggattgatgcaagatggaacacaagaggggggtgaggcttatattatcttgcaccggggtgctcgtagtaggggttacaagcttcgcgagagagggtttgaccttgaagtgagccgtctgagttagcctcctctgcctctcttgggaaggccctgggcatcccctttatagatacaaggggatggtccagctgtacatataggggtgtagctatgtgctaacgtggccggcggagaagttcttgagccctgtagaagcgtagctggcggtgcagcactgggtcccgctgacgtttctttgccttcgtagagagctgagaacaatcgacgtcatggacgcatacagagaaccatcattccatgttgtcggagtaatctagatgtgacaccggtcttgttccttcgtagcctgaggcggctagctaggggtagggtaatgatgtatcccctgtagcatagtcggtccgaggccgaggtcgggcgaggcggtgacttctcctgaggccgaggctgaggttgggcgaggttgtgactcctcccgagaccgaggctgaggtcgagcgaggcgaggaccttctcccgaggccgaggctaaggctgaggcctggggtcgggcgaggcggagctccctgttgcgcccgaggctgaactcgagagaggctgtgacttactgttgttagtcttaccctggtggttggtacagtagtcggaacggggtgaatagtgttgttttcctgtcagaacgatcagtaaaggggcgaagtgactgcagtcatttcgaccttgccaactgaggcgcgcgtgtcaagataaggtgtcaggtgatccccgcattaaatgcgcatgcgatacggtcggtggtaaggcgatttggtcgaggttgttatacgacaaagtttgcctgagcttagcctcgggcgagccgggggtgcgcccactgtctgaggaggccctcgggcgaggcgtgaatccgtccgggactactgttcttgcccgaggccgggctcgggtgagacgagatcgcgtcccttggtagatgaggctttaactttgagctgtgcttaccagtctttacggtctgttttgaagatgttttccagccatgcttaggagtattgagggtacccctaattatagtacccgacaaatttatactatagaaaagctttttttcgtagttgttcggtggcacttgtttgcaacaactactattgtggttgcttgctacaacagtacatcctactctcacataatagtataccccctctgatttttttacctgacagtgtgcaattcaaaattacctaagtggagacaaatataaacaaacggaggtagtactatttactgcacaaacaagtgcttatgctgtaaaatagtgcagccaaacaacttatttgcttcaacttctactttttcaaagcaccacgttcaaaagttgatccaaagacaccctatatcacatatcacactcacgctagacatgtacaactatgggatcacgagtatgattgctaggaatcgaactcgcgtcagcagtcagcacacaggctacgctagccactaagtgcaaggttctggcacgagatcaatctgttgtgaaggattcttaaaacacatcaacaccatatgtggacatattcagcaaattgcaaccagtattgacactgttctagtgttaagagttaaaaggactgttgcaaatattggggactcatatgcataattgtattgaggctcgatataaacacaaagtgaaacctcaagacactaaaagttttgaatattatgccttaacgatccctctcaaatgcaacatgaatgaagtgtaatttaggagagctagcaaaactaaacttgaaaagaaaatgaaactaattaatacatccaaaatcaaatatgacatcaaagcatccaaaataaatgttggagcggtattggatgactgtattgatgccatataaggagtatccacatagtacatgggagactaatggagggaaatcctagaatacaagattacactaatacctttgactattacaccttatcaatgaccacactattggctacttgtataaaaaatttacaatggacaccaatctacttgagttaatcgattcaaagagagaactcacagttagcaacaacgatatgaatagaccaaggcaatgcatagatcaccgtctatccaaaagtttatgcaaacacctactctttcgacttacattttaacaaaagaataaatttgttgcgtcttcgccccaataattggacccatcatttagattgaaatttgcatgtgtaaaatttagaaagataaaataacaaataggaccacaagtgttagctagcttctttattttatcaaagctagacaaaaaaagtagtatatcaaaccttttttcgctttgtgtgtgtgtgaaataaactaaagggcataaaattgtaatactcgatacatatgaatacatggtgtcacgggagaacaacactaacgttgaagatttttatggcaacaagtgttaatattgaccaaacaatgtttatgtaggacatttttaaacatcaagccaacttgaggtatccattgttattagttatgtcaaaatctacaaatgactcacaaagactaaagtttaaatgcagcaatcctgagtaacgtctttattcaactgattgacaagctgaccatgggattaaaaacttcataaaatcgcaggtgagtgaccataactcatgagcaaaggttatctcgcatggtccctcacacccttgtcctatacccttcttgaaaggaaaatgggatttaagttatttctagatttctttgttacttgatgatcatcacaaccatctgagctaactagtttgttgtgtttgatcataggttcataagatcgacaaatcatattctaagtcagaaacaactcaaaaacagcctaagaggcgtatattttggagaagatgagctattggtagttcaacatcttggtcaagttccaaataccctaggaacatatttgaagtatctagagaggttgaaaagctcatgttttagttttgacatttttttctagctaagtttgagccataattggaatatgagttagaagaatcaaagcaaacaattttcatgacttagactggttggctagtttatatattgtcggggaccataattaggggtaccctcaagactcctaattctcagctggtaacccccatcagcataaagctgctaaggcctgatgggtgcaattaagtcagggatcggtccattcgagcgactcgatcacgcctcgcccgagcctagccttggacaagggcagccgaccccggaggatttccgtcttgcccgaggcccccctccgacggcgaacatatttccggctcgcccgaggccctgccttcgctaagaagcaaccctgactaaatcgccgcaccgaccgaccaaatcgcaggagcatttaacgcaaaggtggcctgacacctttatcctgacgcgcgccccccggcagagccgaagtgaccgccgtcacttcgccgctccactgaccggcctgacagaaggacagcgccgcctgcgccactccgactgcagtgccacttgacagattgagactgacaggcagtcaggccctgccaaaggcaccataggaaactccgcttcgcccgacccagggctcggactcgggctaagtcccggaagacggcgaactccgctccgactcaggctaagtcccggaagacggcgaactccgctccgcccgacccagggctcggactcgggctaagtcccggaagacggcgaactccgctccgcccgacccagggctcggactcgggctaagtcccggaagacggcgaactccgctccgcccgacccagggctcggactcgggctaagtcccggaagacagcgaactccgctccgcccgacccagggctcggactcgggctcagccccagaagacgacgaactccgcttcgcccgaccccagggctcggactccgccctgacctctgccgacgacctccgcctcgcccgacctaggggctcggactcggcctcggccatggaagacagactcgaccttggcttcagaggagcctccacatcgcccaacctagggcgcaggccagccacgtcaacaggaggtgccatcatcaccctaccccgagctgactcgggccgcagggaacaagaccggtgtcccatctggctagctctgccagataggcaatgatggcgccccgcatactctgtgacgacggtgtctctcagcccccttacggaagcaagaggacgtcagcaaggactcaaccgctccgacagctgtccctccgccaggctccatcgctcctccgacggccacgacatcacaccagctgggtgccaaaatctctctggctgccacatcggcatgtacttagggcgctagctctcccccgctagacacgtagcactctgctacaccccccattgtacacctggatcctctccttacgcctataaaaggaaggaccagggccctcttagagagggttggccgcgcggggacgaggacgagacaggcgctcgcttggagccgctcgcttccctctcccgcgtggatgcttgtaaccccctactacaagcgcacccgacctgggcgtgggacgaacacgaaggccgcgggattcccacctctctcacgccggtctccggccgcctcgctctccccccttcgcgctcgccctcgcgctcgacccatctgggttggggcacgtggcgacactcactcgtcggcccaagggacccccggtctcggaacgccgacagttggcgcgccaggtaggggcctgctgcgtgttgacgaacagcttcccgtcaagctccagatgggcagtctccagcaacctctccaacccgggacggtgctccgtttcgggagtcttgagtttatgtccttcgacgacagctacgacatgatactccttcccccgccgcgcgacgacgacaatggcggccgacagcccacccgccggcggcggaatcgacgacgtcttccccgcatggtggaagaacaaccttcgacctcatcccgccttcttccccgccgacggaggggaaggcagggcaaccaaggccaagcaggaggcagcgcctcgtcggctgtcgagcaagtcgacagcgccggcaccccaacggggggcgtaccgggtatcgacttcacgcttgagacgaagacgagcgccgtctccccgcgacacgccaatcccgagcaagcgaacgacgccagcgtgctcgcgaaaagcttgctgggcgtcgccctcgtacttgagacgacggtgcagtcagtccccgacgtgactttatcgccgctcgtcgaccaagaggtaccgatcgattcccatcccacatcatttggattcagcctcaacccgcctagcgacctcgctttggcgggcgctctcgtagaggcgagtccaaaccctctggggtttcgcatgcggtcaccttgggaccggttgacggacgtctcgacctacgggccctctgggtccgaggaagacgacgaccccagcatctgttgggatttctctggacttggcaaccctagtgccttgtgggacttcataaccgcatgtgactactgcctctccgactgttccgacggtagccgcagcctcgacgacgaggactgcggcccaagccgcgaatgtttccacgtcaatctagggggtccctccgaaggcaatcatctcggcatgccggaggacggtgatctccctaggccggtaccccgcgttgacatcccacgggagctagctgtggtccccgttcaggcgaggggccatgacccacagctcgagcaaatccgcggggtgcaggccaggctcgacgagggagcaggagcgcttgagccaatccgccgggacatcgggcaggcatgggcgggccaacccctggccggagaaatacgtcatctgccccagggtttccagcaccgcgtcgcagacgacgtcagggtcaggccaccaccagcatctagtggggtcggccagaacctggctgcagcagtgatgcttctccgcgcgatgccagagccatcaaccatcgagggtcggcgaatccagggggagctcaagaatctcctggaaggcgccgcggtccgacgggccgagagctctgcctcccgaaggcaggggtacccctcggaacctcatgccgcgacttcccgattcatgcgggaagcctcggtctacaccgggcgcacgcgcaacaccgcgcctgcggccccgggccgcctcggcaacgagcaccatcaccacgaccgtcgggcccacctcgacgagagggtgcgccgaggctaccaccccaggcgtgggggacgctacgacagtggggaggatcggagtccctcgcccgaaccgcccggtccgcaggccttcagccgggccatccgacgggcaccgttcccgacccggttccgacccccgactactatcacaaagtactcgggggagacgagaccggaactgtggctcgcggactaccgcctggcctaccaactgggtggaacagacgatgacaacctcatcatccgcaacctccccatgttcctctccgacaccgctcgcgcctggatggagcacctgcctccggggcagatctccaactgggacgacctagtccaagctttcgccggcaatttccagggcacgtacgtgcgccccgggaattcctgggacccccgaagctgccggcagcagccgggagagtctctccgggactacatccggcgattctcgaagcagcgcaccgagctgcccaacatcaccgactcggatgtcatcggcgcgttcctcgccggcaccacctgccgcgacctggtgagcaagttgggtcgcaagaccccaccagagcgagcgagctgatggacccgcccgttggaagatgctcccgaggcgtcgactcagcgcggcgccaagaagaaaggcaagaagaagtcgcaagcgaaacgtgacgccgccgacgcggaccttgtcgccgccgccgagtacaagaaccctcggaagccccccgaaggtgccaacctcttcgacaagatgctcaaggagccgtgcccctatcatcaggggcccgtcaagcacacccttgaggagtgcgtcatgcttcggcgccacttccacaaggccgggccacccgcggagtgtggcagggcccgcggcgacgacaagaaggaagatcaccaagcaggagagttccccgaggtccgcgactgcttcatgatctacggtgggcaagcggcgaatgcctcggctcggcaccgcaaacaagagcgccgggaggtctgctcggtgaaggtggcggcgccagtctacctagactggtccgacaagcccatcaccttcgaccaagccgaccaccccgaccacgtgccaagcccggggaaatacccgctcgtcgtcgaccccgtcatcggcgacgtcaggctcaccaaggtccttatggatggaggcagcagcctcaacatcatctacgccgagaccctcaggctcctgcgtgtcgatctgtcctccgtccgagcaggcgctgcgcccttccacgggatcattcccgggaagcgcgtctagcccctcggacgacttgaccttcccgtctgcttcggaacgccctccaacttccgaagggagaccctgacgttcgaggtggtcgggttcctaggaacctaccacgcggtactgggaaggccatgctacgcgaagttcatggtcgtccccaactacacctacttgaagctcaagatgccgggccccaacggggtcatcaccatccaccccacgtacaaacacacgttcgaatgcgacgtggagtgcgtggagtacgccgaggccctcgccgagtccgaggccctcatcgccgacttggaaaacctctctaaggaggtgccggacgtgaaacgtcatgccggcaacttcgagccagtggagacggttaaggccgttccccttgaccccagcggcgacgcctccaagcaaatccggatcggcttcgggctcgatcccaaataggaagcagtgctcgtcgacttcctccgtgcgagcgccgacgtcttcgcgtggagtccctcggacgtgcccggcataccgagggatgtcgctgagcactcgctggatattcgggccggagcccgacccgtcaaatagtctctgcgccgattcaacgaggagaagcgcagagcgataggcgaggagatccacaagctaatggcggcgaagtccataaaagaggcgaaaagcgtcaagctcaaccccgaaaggtgggtcctcggggtgccccagggcatggtcttggggttcatcatctccaagcggggcatcgaagccaacccggagaagatcgcgaccatcgcacagcaccccgagcccttgctgggggcacccgggggctacacgcacccccgggaaaggccgcttgtcatcgccaaagttctggagcccggaacgtacaagctggccggcggtcaaggcgaggtctacggcaacgcttggaacatccgacagctacgtcgcttctacccttaagatgttttcaagctgttcgtatacctcgctcccacacaagtctcagtcgtcaaggaagggtcagcctcgcctcggcagagcccgaccctccctcggggggctaaaaagggggaaacccctctgcgtcaagattgggtgtacctctccgcatccaaaattttcggtcaaaaaggcttttgtgttctcccggctatgtcagaagcagggccccaaggagcgaacgtgggtgcatgtaagtggcaaggccgactgagccgaggaactcctatgcctccgggttagggacacctcactcatcacccgccacgaaaaatgacccctactcgggaagccaccctgttattgacaggcaaagccggacacgcaaaataaaaggaagaggagtacgacttcatgcaatggaaataaagtgttcaggcctcagcggccgcagaaagacacacgcgcatccaacagaaactgttccaacagagttaggcgtcgccttgggaaggagtcgcgccttcagctccatccccgccttcggtaaagtccatctcggcttccggcgacggcgcaggggggaggatctccgcctcaaaggtggtcgccagcactgtgctcggacccgcggcggccgcgtcgagccgctggacttctgccagggcagcttcgtcttcgtcaggaagacaatacccctcactaacccgctccaggtccacaacgtagtgggaagcgagcacggcgaaggcccgcctgacgtcgtggtgtagcgcctcgcagagtctgccgcgcacgtgatcacccaaggcttgaaggcgactttgaggggagcttcctgaggggacgtcgtcggagccaaggattcgataaacgtccgagacggcttcggacatggccgcgtggtcggcctccctctgctcggccgccccggcaagcgcctcggcaagcgccttggcggactcatcaagggcggactcgagctctgcgaacagccagaagaaagatctcaaacacaagcagaggaaacaaataggaacgagaaccaaggatggccaaggcgtacctccggctcgggaacgctgctccgaggccgcgacctgggctacggctaagtcggctgcaagggtttcggcccggctttcggcctcggcagcccagccccgagattggtcccgctcctcgacgacccggtcgaactccgaccgctgccgttgcgcttctgcgcgcgccgcagccgcctccgtgtgcgccgctgccgcctcggctctcaggtcagtgcagagcaactggaggtccgctacctcggcaccctgctgagaaaggcgcgcagtagccccggcgagcgaggtcctcagggatcgcagcgagccccagacgtcgacctcgcggcggatgaacgacgacttggcggcgctccgatccgtcagatcctgagggaaggaagcggggcgtcacgaagaacgcctcggtcacagaagagaaaaggtatgcctgaaaccgttacctggaggattttggggacgtccctgcagaaaacctccagcgacgaccggagcgaccccaccgttgctttagcacactcgcggagctcatcccaggactggtcctcccgttcatcgtcgagaacgaagacggggtccgaggcctcacgggtctggaaccggagcaactggcgccggccctcggagctctgccacacagcgacgaggctgccgcccggcgggacggatcgcgcctccacgcccccctcttctgaggcaccaagcgccgacgcatcagccgcctcaacgtcggcagcaaccggtcgctctccgactgggacggcggcaacttcggtagcggcaggcgccggcatggccggcacgtccggtgggctcgggaccacgtcagcgtcagccgcctcccctatcacaatggccgcctcggtagaagagccagccttgggaacctgccccacggcgaccggtgccgcccgagccccctgcggtggaacgccttgcgagaaggtcggctgaacggcaaggcccggagcggcgctggccgcacaggccggcgtcgtcttaagggccttccggggtgccaggtcggtcaggccatggcttcgcttgctgagggaaaaagaaaaatcacggccgggatatatgaatggaaagccaggacgaagacattccgagatacttacccgctccgggccatgatccaccgtgcctggggggaagtctcttggatctcggcccccggaaccgccgccgaggtccgcttcgccggcaacttcgacaccacccttgctttggacgcccggggggcagattgcccaggcactgtcacggtgaccttagggtcgcctccctgcgctgccgacgcgagcggcggctctcggggagcagacgccctggcctggccccccggggtcacctcagctcctccagccgaggggtcaggtgccctctcgggttgcccccgcccctcgggccgggaccccgatgccccgactccggggactgacggcgtcagcccgctcgggggctggcttgacggctcctggccaaaccccaagccggggctgaggccgaggcgggcggccatgtcgtcctcctcgtcatcatcttcatcatcgtcgtcgtcgtcgggcgtttccggcgacggctccctcgggagcccctccctctcctgccggcgacggagcttttccaaggcgtctcgagcccgcctccgctcgtgggcccgggccttctctgcgtccttcttcttcttctcctccacggcgacccgccgcgctgctcggtccaccgcatcctgcgggacccgtggcagggaaggcttgtgccaccccacctcctgaagaaggggggaaaaccccgatcgtaagaaccaggagcgacccgatgtatgaagaaggaaggagcggacactcaccagagtcacgcaccctcggtcggggcgcatcaaaagctgggagaaggcgtgggggtccggcttccccaacgcgacggacacccgccattggagggcgtcgaagggaagaggatcagaggacatccgcgagccctcccagtcagcctccagggtcatctcccaaagcgacagtcgtcgctccgccaagggaagcaccctccgacggtggatggcggcaatcactcccgcagcggtgagtccccccttccgcaacgcctccaaggcctggagaaggggttcgaggttcttctgtctttcgtgccgggtcccgtggcgccaagcgtcggtggcagtggtgactactcgctgagagaacggcgggagcaactcgccgtcattccggaggtagaaccaccggcgctgccaccccttgtttgaggacgcgaggatggcaggaatatacagcgacgcccgcgactgcctcagcaggagggtgcagccgccggcccgcaccgctgcgcaaactttcctctcccccgtcggtgaggcaaaaagctccgcgaaaaagagatgggtccacaaatcccaatggggggcgatccccaagtacccctcgcacaccgctacgaagatggcggcctgcaagatggagttgggggtgaggttgtgcaactccaccccatagtggtacaagatcgcccgcataaagcggcccgccgacacaccgaatccccgctcgtggaaggagacaaagctcacgatgtaccccggcggtggggacggagcggctacgcccacgggaggaatccattccggtcgctgctcatcggtgagagggcgaagcaaaccctcgccgaccagatcctccagatcactcgtcgtcaccgtggaaaaaggccatggatcgcgcggcgagatgatggtcacccggtcagccatcaccgagcggaagggatggcggcgcaaggggcaggaagggcggtttcctcttctctggctaagtctctcgggttgcgaaaacctaagagggaggcaggaagcggagcaaagaaccgtcactagaccctctcccgggtatataaagaccaaggcgagaccggttccaacgttccgcccggaccggacgcgggattcaaaaacgcgaagcgaaacagccgttcctcgaacggctcgcgcacgcgcaacgaccgccccgccaaccactcgccccgtcgcattaactccgcggcgggacaggcggcgcttctggcaggagaagcgggcgacgcttcgccttcgccgtaataaccgcgccaaaaaaggtacgccgcgtcgtttgatttcatatccttttccttttttcctctttctctctctcttgcaacagggaccgggaaagggggataccccgaaaagcatccttccccgtgaaggaacaaggctccgagcctccctactgatcagaggtttgaaggctggccccccgaagggttcgacagccgcctcagatcgcgtgggccctacacccactactggtcagaggttcgaaggtcggccccccgaagggttccacggccgcctcaggctactcgggctccgcgcccattactgattaggggttcaaaggctggcccccgaagggttcacagccgcctcagacgccgagcgagggatgaccatgggtacgttcgatacataaccaaggctcgggctacgctcccgaggtaccctaggacatttccgagaccagcgggagcgatcttgtaacggaatcccattagagggaggcatcgatccctcggaccccgtcgccaggggaccgggtccggcagatcacccgcaggtacttttgggcgtgcctctgggcccctagccgacccctaacaaacggggcacggacgtccactcggattacccgcttgcagctcaccggagacaccatgttcggcgcccatcgagggcaacatggcgctttcccccctcctccttgtggaaaggcgacgcaggggcgtatgtaaaaaagctgagtctgtccctgatcgccctctcgccctgtgcagaggctcgggggctgctctcgcaaacccggctccggccgaaccgttgacagcgtcaacataccagcccgagaacttgggacccgaccgtacacccgggctacggccagctcgcatgagggaacaaccagaccagccgaagcattgcgcgaggcattaagacctcgaaggagtgaaaccactcctccgaggcctcgggggctacacccggcgggtgcgctcgcgcgcacccaccggaacaaaatgcaaccgagaaaggctggtccccttgcaaaaaagtgcgacgaaagcctccaagcgagtgctaacactcccttcgaggctcgggggctactgtcggggaccataattaggggtaccctcaagactcctaattctcagctggtaacccccatcagcataaagctgctaaggcctgatgggtgcgattaagtcagggatcggtccattcgagcgactcgatcacgcctcgctcgagcctagcctcggacaagggcagccgaccccggaggatttccgtctcgcccgaggcccccctccgacggcgaacatatttccggctcgcccgaggccctgccttcgctaagaagcaaccctgactaaatcgccgcaccgaccgaccaaatcgcaggagcatttaacgcaaaggtggcctgacacctttatcctgacgcgcgccccccggcagagccgaagtgaccgccgtcacttcgccgctccactgaccggcctgacagaaggacagcgccgcctgcgccactccaactgcagtgccacttgacagagtgagactgacaggcagtcaggccctgccaaaggcaccataggaaactccacttcgcccgacccagggcttggactcgggctaagtcccggaagacggcgaactccgctccgcccgacctagggctcggactcgggctaagtcccggaagacgacaaactccgctccgcccgacccagggctcggactcgggctaagtcccggaagacggcgaactccgctccgcccgacccagggctcggactcgggctaagtccaggaagacggcgaactccgctccgcccgacccagggctcggactcgggctcagccccagaagacgacgaactccgcttcgcccgaccccagggctcggactccgccctgacctctgccgacgacctccgcctcgcccgacccaggggctcggactcggcctcggccatggaagacagactcgacctcggcttcggaggagcctccacatcgcccaacctagggcgcaggccagccacgtcaacaggaggcgccatcatcaccctaccccgagctgactcgggccgcagggaacaagaccggtgtcccatctggctagctccgccagataggcaatgatggcgccccgcatactctgtgacgacggcggctctcagcccccttacggaagcaagaggacgtcagcaaggactcaaccgctccgacagctgtccctccgccaggctccatcgctcctccgacggtcacgacatcacaccagctgggtgccaaaatctcttcggctgccacatcggcatgtacttagggcgctagctctcccccgctagacacgtagcactctgctacaccccccattgtacacctggatcctctccttacgcctataaaaggaaggaccagggccctcttagagagggttggccgcgcggggacgaagacgagacaggcgctcgcttggagccgctcgcttccctctcccgcgtggacgcttgtaaccccctactgcaagcgcacccgacctgggcgcgggacgaacacgaaggccgcgggattcccacctctctcacgccggtctccggctgcctcgctctcccccttcgcgctcgccctcgcgctcgacccatctgggctggggcacgcggcgacactcactcgtcggcccaagggaccccccggtctcggaacgccgacatatttatatttgtctaactcataggaacaccctcaaagtcagccaaaataagttgaagaaaaaaagcataaaattcagaaaaaacacctggtctgcgactcactagaccgatccagtgtgccactggactacgtacgcagagaacccttcttcaacacttcgacaacctgtttcatcaaaccagtccggcgtgccaccgaaccgaagttctagagaggttgttttggagaagttgaacaccctggcgcaccgacttagtctggtgtgccacagggccatgaagttctaatggttactttccagatctaatggttgagctgacgtgacaggggtctagtgtgtcactagacaagcactgtgcaacctgacacttcaaaacagtcattggtcgagtagtctgactagtactgttcaagggtcgttgtgctcgcaaaaagagcctttttagcattgatgttcaatgactatatgggttgttggaggctatgaatacatcccagctatataatcaacacacaactcttgagcattcactcctacaagctagagaagcattcccaacacctccaagtaatctaagttccctagttgagtagagttcatcctctagagagaaaagaaagtgtgcacttatgcttgagctgaaaagatagagtgtcttggtgaaaggaacccattgagattgtaaaggctagcaagaggctttaatgttgtggagtaccttgcaggagacttaggtctcttgatcatttgataaaagagaagagggatcgagtttgaactttgaaatcactcgagagggttgaaagagacacatcctttggggcacctcaacgaggacatatgttctttggaatcgaaccttggtaaaccaaatcgctcatgtctttcgtttgtgttctccatcttatattctaaagctctccccactccgatcgtattacttctcgctctaacacctaatttggatcaaagtttttattgttaagtgttaaatttcagatttcgcttattcacctcctctaggtgactttcactttctgttgatcgatgattatgaatctagcatgcatcgactactagctaacatgaattataaagggaagtatggttgtttatctactagcacacaaacagtaaatcaaatcaattttgtgtgtgcatagagatggtgcatggaagctcttcttttattgctgcttagacaacaagatgccaaagaaagccctatcactgttagtcgagagagctaaaaatttcatctcatacactagtttggaatttagatggtactccatgtttcatctaaccaccatggttgatgtcaaccttccgaccaccagctctgcgatcccatccaccaccagagtgaatgtcggatcttggtccgacatggacttataagtgtcagggatggtgataggtggctcggaggcgagggtgaagtgctcctgcttgttgttctatagatagaaccacgatgccttccaaacatcctaacgacctaccgagtctgatgtgatatactttgtaggggcccctgatgcacccctagaagtaacactcaccgatgatcattcctcgcttggtccactagaggacgaagaattagcgatagaagaacaatgacactttggaaggaggaaggttaggtgctcgggcatttgggtacctgaaaggaaaatatgcccttgggccatttctaagtgttttggtgatttagtgtccaacacaagtgcctaagtgtcaaatggtggacaaagtacaaaggtatgtttctcagacttagtacattgttttagagactaatgtattgtgtctaagtgctggaaacaggaaaagaacaattggaaatgtcttgactcgagcagccaagactctgctcagtctgggagcaccggactgtccggtggtgcaccggacagtgttcggtgcgccaggctggctcaggcgaactgaccgctcttgggaaaaatttaacggcgtatggctataactcaccggactgtccggtgagccaacggtcggccgggccaacggtcggctgcacaatccgcgcgaggcacgtgaccgagccaacggtcgggaggtgcaccggactgtccggtgtgcaccggactgtgtccggtgcgccaacggttccaaggctgccaacggtcggcttcgccaaataaggaaggaaatccgcaccggacagtgtccggtggtgcaccggactgtccggtgcgccaggcgacagaaggcaagaattgccttcccggaatgctctcaatggctcctagctgccttggggctataaaagggacccctaggcgcatgaaggagataaccaagcattccttgagcactcttgatcattcacacctcattcttgcgcacttgttcgacattctagtgatttgagctccgttctagtgtgctagtcttttgagcttaagtctgggtcttgtgtgtgcgtacttgctgtgatctttgtgtcttgtgtgagttgctaatcccttccttactccgtgcttctttgtgaacatcaaagtgtaagggcgagaggctccaagttgtggagattcctcgcgaacgggattaagaaaagcaaagcaaaaacaccgtggtattcaagtgggtctttggatcgcttgagaggggttgattgcaaccctcgtccattgggacgccacaacgtggagtaggcaagcgttggtcttggccgaaccacgggataaccaccgtgccatctctgtgattgatatctctgtagttattgtgttttgttgagactcctctctagccacttggcaattatcgtgctaacacttaaccaagtttttgtggcttaagtttcaagttttataggatcacctattcacccccctctaggtgctctcaattggtatcagagtcgttctcttcaagaaagggactaaccgcccgaagagatggatcctaagggcaaggggattgtgatcaatgacaaggagaaggagtcattcgtcaatgagcccaaggatgacaagcctaccgactcaggctcgggccacaaacgcaaggatgggaagaagaagaagacaaggtgcatcaaggagatcgtctactacgacgacagcgatgaatccacttcttcccagaaggacaacgacgacaacgactacgagagaaggaaaccggttaattcgaacttttcttttgactactctcgtattccgcaaagtacaaatgctcatttgctctccattccacttggcaaacctcctcactttgatggagaggactacggattttggagccacaaaatgcgtagtcacctgttctctctccatccaagcatatgggagattgtggaaagtggaatgaaatttgatagctcgaatagtcctatgtttatcaatgaacagattcatagaaatgcacaagctactactgtgttgctagcctctttgtgcagggatgagtaccataaggtgagcgggttggacaatgccaagcagatctggaacaccctcaagatctctcatgaggggaacgacgtcaccttactcaccaaaatggagttggtggagggcgagcttggaagatttgcaatgataatgggtgaggagccaacccaaacatacaaccggctcaagacccttatcaacaaaataaggagctacggaagcacgcgatggacggatcatgacgtcgtccacctaatgctaaggtcttttactgtacttgatccacatttggtgaacaatattcgtgaaaatcctaggtacaccaagatgtcgcctgaagaagtccttggaaagttcgtaagcgggcgaatgatgatgaaggaggcaaggtacgtggacgacgcgttgaacggtccaacccatgagcctcaacccattgctctcaaggcaacgaggagcaaggagacgctacctagcaaggtggcgcaagttgaggcggccggcctcaatgatgaagagatggccctcatcatcaagcgcttcaagacggcgctaaagggtcgcaagggacaaccaagcaagaccaagacaaaggggaagcgttcatgcttcaaatgcggtaagattggtcattttattgctaactgtcccgataatgaaagtgaccaggaacaagggagcaagagggagaagaagaaggtatacaagaaggctaagggcgaggcacaccttggcaaggaatgggactcggattgttcgtcatccgactccgacaatgaaggactcgtcgccaccgccttcaacaaatcatccctcttcccaaacgagcgtcacacatgtctcatggcgaaggagaagaaggtatgtaatcgaaataatgccacttatgattcctctagtgatgatgagtctagtgatgaagaaatagattactctagtttgttcaagggattggatagagctaaaatagataagattaatgaattgattgatgccttgaatgaaaaggatagacttttagagaaacaagaggaccttttatatgaagagcatgataaatttgttagtgcacaaaattcacttgctctagaagttaaaagaaatgaaattctttctagtgaagtgtctacatgtcatgattctgtctctagcttaaagagaattaacaatgatttaaatgctaaactagaagtagcaaataaatctaactcttgtgtagaacatgttatgatttgtactaggtgtaaagattttgacattgatgcttgtagtgaacacctagtttgcatttctaaattaaatgatgaagttgctagtcttaatgcccaacttaagactagcaagagtgaatttgacaagctaaaatttgcaagggatgcctacacgattggtagacacccctcaattaaggatggtcttggcttcaagagggaagtcaagaacttaacaagccataaggcttccatctccaccaaggagaaagggaaggcccctatggctagtagtgtgcaaaagaaccatgctttcatgtatcatgataggagacattctaggaaggcctttagaagttatgatgcttttgattctaatgctatgagtgcttctagttcnnnnnnnnnnnnnnnnnnnnnnnnnnnnnnnnnnnnnnnngcaagatgcaagggagataaaacttgcatttgggtacctaagacccaagcctaaatttgccttgcaggtttatgcatccgggggtacaagctggattatcgacagcggatgcacaaaccacatgacgggggaaaagaggatgttctcttcctacgtcaagaacaaggattcccaggattcaataatattcggtgatgggaaccaaggcaaggtaaaagggttaggtaaaattgctatttcatccgagcactctatatccaatgtgtttttagttgagtctctcggatataatttgttatctgttagtcaattgtgcaatatgggatataattgtctattcacaaatgtagatgtgtctgtctttagaaggtgtgatggttcactagcttttaagggtgtactagacgacaaactttatttagttgattttgcaaaagaagaggccggtctagatgcatgcttaattgctaagacttgcatgggctggctgtggcatcgtcgtttagcacatgtggggatgaagaaccttcacaaacttctaaagggagaacacgtgataggtctaactaacgtacatttcgaaaaagatagaccttgtgcagcctatcaagcagggaaacaggtgggaggctctcatcacacaaaaaatgtgatgaccacatcaagacccttggagatgcttcatatggacctcttcggacccgtcgcctatctaagtataggaggaagtaagtatggtcttgttatagttgatgatttttcccgcttcacttgggtattctttttgcaggacaaatctgaaacccaggggaccctcaagcgcttcctcaggagagctcaaaatgagtttgagctcaaggtgaagaagataaggagtgacaacgggtccgagttcaagaaccttcaagtggaggagttccttgaggaggaagggatcaagcacgagttctccgctccctacacaccacaacaaaatggtgtggtagacaggaagaacaggacgctcatcgatatggtgaggactatgcttggagagttcaagaccctcgagcgcttttggtcagaagccgtgaacacggcttgccacgccatcaaccgggtctaccttcaccgcctcctcaagaagacttcgtatgagctgctaactggtaacaaacccaatgtgtcttattttcgtgtatttgggagcaagtgttatattcgtgtgaagaaaggtagaacttctaaatttgctcccaaagctatagaagggtttttattaggttacgactcaaatacaaaggcgtatagggtcttcaacaaatcatcgggtttggttgaagtctctagcgacgttgtatttgatgagactaatggctctccaagagagcaagttgttgatcttgatgatgtagatgaagaagacgttccaacggccgctatgcgcaccatggcgattggcgatgtgcgaccacaggaacatttggagcaagatcaaccttcttcctcaacaatggtgcatcccccaactcaagatgatgaacaggtacctcaagtggaggcgcatgatcaagggggagcacaggatgttcaagttgaagaggaagaagcacctcaggcacctccaacccaagttcgagcgacgattcaaaggaatcatcccgtcgaccaaattttgggtgatattagtgagagcacctagaggggggggtgaataggtgatcctggaaaacttaaaacttaagccacaaaacttggttaagtgttagcacaataatcgccaagtggctagagaggagtctcaacaaaacacaataaccacaaagatatcaatcacagagatggcacggtggttatcccgtggttcggccaagaccaacgcttgcctattccacgttgtggcgtcccaacggacgagggttgcaatcaacccctctcaagcggtccaaagacccacttgaataccacggtgtttttctttgcttttcttaatcccgtttgcgaggaatctccacaacttggagcctctcgcccttacacttgaagttcacaaagaagcacggagcaagggagggattagcatctcacacaagacacaaagatcacagcaaatacgcacacacaagacccagacttgagctcaagagactagcacactagaacggagctcaaatcactagaatgtcgaacaagtgcgcaagaatgaagtgtgagtgatcaagaatgcttaggaatgcttggtatcctcctccatgcgcctaggggtcccttttatagccccaaggcagctaggagccgttgagagcaatctaggaaggcaattcttgccttctatcgcctggcgcaccggacactgtccggtgcccgatttctttccttctatggcgaagccgaccgttggcagccttggagccgttggcgcaccggacatgtccggtgcacaccggacagtccggtgcctccttctagtcgttggctcggccacgtgtcccgcgcagatcgtgcggccgaccgttggcccggccgaccgttggctcaccggacagtccggtgcacaccggacagtccggtgaattatagtcgtacgtcgccggtgaattcccgagagtggccagttcgctcgagccagcctggcgcaccggacactgtccggtgcaccaccggacagtccggtgctcctagactgagcagagtcttggctgctcgagccaagacaattccaattcgatttttcctgtttccagcacttagacacaatacattagtctctaaaacaatgtactaagtctgagaaacatacctttatccttgatttgtactttgtccaccattttacacttaggcacttgtgttggacactaaatcaccaaaatacttagaaatggcccaagggcacatttccctttcaatctccccctttttggtgatttatgccaacacaatataaagcaagtagaacaaatacaaaatcaattcaaataagaactcaaattgttttgattcaaatttgacatatatggatcactctttgccaccacttggtttgtttttgcaaatcaaactcaaatttctatctctaagtcaaacacacatgttaagacataaagagagtcattccaagagaaattgattcaagatttcaaaaactcccctttttcccataatcaacacttctccccacaagaagccaacttttgacgagagagacaataaaagagttttgacaaaccaaaagctctattctactattttcaaaatctctcaagtggtagctgttccatttatcgctttggcctttattttctccccctttggcatcaagcaccaaaacgggattaatcttggccccagaaccccattgcctcaccaaaatcttcaataagaatacaaaggcaataagagtacatgagatgaacttggaataagttaccctctcatcggagtgcagtggaagtctttcatggtccaagtccaccttttccctttcaaacctcctttgagactaaaacaagcaaactcaagcacatggttagtctcaaagggtcaagttgtagcacagctccccctaaatatgtgcatcacttgcgaaaaggacttgtgaggtccggagagtgtttgtacaacttgagcaccataagtaagcaacgaaatgcataaggaacatgatcaagggcataaacacatgtatgctgtaaatcaatccaggtttcgtgaatctaagacatttagctcactacgcaacctgcaaaaggtctgctcatctagaggcttggtaaagatattggctagctggttctcggagctaacatggaacactttgatatcccccttttgctggtggtctctcaaaaagtgatgtcagatgtcaatgtgctttgtgcggctgtgttcaacaggattttccgccatgtggatagcactctcattatcacataggagtgggactttgctcagattgtagccaaagtccctgagggtttgcctcatccaaagtagttgcgcgcaacactgtcctgcggcaacatactcggcctcagcggtggatagggcaacggaagtttgtttcttagagttccatgacaccagggaccttcctaagaattggcatgtccccgatgtactcttcctatcgaccttacatccagcatagtcggaatctgaatatccaatgaagtcaaaggtagacccctttggataccagatcccgaagcaaggcgtagcaactaaatatctaagaattcgcttcaccgccactaagtgacactccttaggatcggattgaaatctagcacacatgcatacgctaagcataatatccggtctactagcacataaataaagtaaagaccctatcattgatcggtatgccttttgatcaacggacttacctcctttgttgaggtcggtgtgtccgttggtccccatcggagtctttgcgggcttggcgtccttcatcccaaaccgctttagcaagtcttgcgtgtacttcgtttgggagatgaaggtgccgtccttgagttgcttcacttggaacccaaggaagtagttcaactcgcccatcatcgacatctcgaatttctgcgtcatcaccctgctaaactcttcacaagacttttggttagttgaaccaaatattatgtcatcgacataaatttggcacacaaacaaatcaccatcacatgtcttagtgaaaagagttggatcggctttcccaaccttgaaagcattagcaattaagaaatctctaaggcattcataccatgctcttggggcttgcttaagtccatagagtgccttagagagcttacacacgtggtcagggtaccgttcatcctcgaagccaggggttgctccacgtacacctcctccttgattggcccgttgaggaaagcgctcttcacatccatttggaacaacctgaaagaatggtgagcggcatatgctagcaaaatacgaatggactctagcctagccacaggagcaaaagtctcctcaaagtccaaacctgcgacttgggcataaccttttgccacaagtcgagccttgttccttgtcaccaccacgtgctcgtcttgtttgttgcggaacacccacttggttcccacaacattttgcttaggacgaggcaccagcgtccaaacttcattcctcttgaagtttatgagctcctcttgcatggccaacacccagtccggatctagcaaggcctcttctaccctgaaaggctcaatagaagagacaaaggagtaatgctcacaaaaattaactaatcgagatcgagtagttactcccttgctaatatcacctagaatttggtcgacgggatgatccctttgaatcatcgctcgaacttgggttggaggtgccggttgcgcttcttcctccaccacatgatcatcttgtgctcccccttgatcacacgcctcctgttgatgaacctgttcatcgtcttgagttggggggatgcaccatagttgaggaagaaggttgatctcgctcattttgttcctgtggccgcacctctccaatcgccatggtgcgtattacggccgttggaacgtcttcttcatctacatcatcaagatcaacaacttgctctcttggagagccattagtctcatcaaatacaacgtcgctagagacttcaaccaaacccgatgatttgttgaagactctatacgcctttgtatttgagtcataacctaacaaaaccccttctacggctttgggagaaaatttggaattcctacccttcttcactagaatgtagcatttactcccaaatacacgaaagtacgatacattgggtttgttatcggttagcagctcatacgacgtcttcttgaggaggcgatgaaggtagaccctgttgatggcgtggcaagccgtgttcacggcttccgaccaaaagcactcgggggtcttgaactctccaagcatcgtcctcgccatatcgatgagcgtcctattcttcctctctaccacaccattttgttgtggtgtgtagggagcggagaactcgtgcttgatcccttcctcctcaaggaactcctccacttgaaggttcttgaactcggacccgttgtcgctccttatcttcttcaccttgagctcaaactcattttgagctctccttaggaagtgcttgagggtcccttgggtttcagacttatcctgcaaaaagaacacccaagtgaagcgggaaaagtcatcaacaataactagaccatacttacttcctcctatgcttagataggcgacgggtccgaagaggtccatatgtagcagctccaggggtcttgatgtggtcatcacattcttgctgtgatgtgctcctcccacttgtttacctacttgacaagctgcacaaggtctatctttttcgaaagtaacattgattagacctattacgtgttctccctttagaagcttgtgtaagttcttcatccccacatgtgctaagcggcgatgccacagccagcccatgctagtcttagcaattaagcatgcatctagaccggcctcctcttttgcaaaatcaactaaataaagtttgccgtctaatacacccttaaaagctagtgaaccatcacttcttctaaagacagacacatccatatttgtaaatagacaattataacccatattacataattgactaacagatagcaaattatatccaagacactcaactaaaaacacattagagatagagtgctcatttgaaattgcaatcttgcctaagcctttcaccttgccttggttcccatcaccaaatatgattgaatcttgggaatccttattcttgactgaaagtaccctagagggggggggggtgaataggctacacctgaaaattttcactaaaaacttcgagataggttaaattaaagttgcactggtgcaaaccggttcagtcgattttaattacaactgaacaagtttgaacctgctcaacttaaattagataatctattgaacaaatacgaagtagtgaagaatatagctaaagacttgccctacacaaaatctacttgaatgaataatatgacccaaccaccgaatataaagcgcttgacaagaacacacaagaacacgcgatataacccgaggttcggcaaccaccacaaaggtgtcctactcctcgttgaggaacccacaaagggtcgggtcttttccaaccctaatcctccacaagccgaccataaaggtcaaggcaatctcttctcaaatcagctcaaagagcgggtgatacaaacttcttggggtcgtccacaaatttggagactcccaagcaacctctaaccgtcaaggaacacgaggtttcaagagtaacaaatccgcacacggttaagtttgcaacgagctcaagaacaaagagaatgggagaatcgagatgaaattgacagcgagttcgatcgagttcacctcacaccaagggtccttcaaatgattgaaggagatgcgattgcgggtgtgaaaggtgaaatgaatgcgcttgtttgaaggttggtcagccaagaattcgtgggagagacaggagtaaatgagagagagagtgcgagggggtatataaaggatcccccaaaagctggcagccgttgggagaaaaagagtaaaaaccggttgaaccggttttcagaccggttgaaccggtttctaccagggggatcccggtccactgagctactcagtcggagactcgacccgtttcaaaaccggctgagtaaggaaaaaattcggctcaaccggttttagaaaaatatctgctgcgacttttctgacagctctgactgtcagacaggtcagagcagatgtggcaggtgaacagtaccgaaaccggttgaaccggtttcaggaccggttgaaccggttttgggggctgaaaccaaattttgagtattttgaagggaacaaaagtggagtatttgtgggaagtaaaatttgtttttctcaagggcattcatgatctgaaaaaaataatctccaagaagttttcaaaagattttgaacttggctcatttcacaacttacttaaccgtcgcggatccctcttaattgtacggcgattcctatgactcaagaattataaatttagcaccgccgttgtttctaggcacttggagcatgccatttgatgtggaattttaaatccgctgtgctttatacttttatgctcgtaagatctgtgcttctcctgtctgtagaaatattgtgtacatactaggagcaaacttgttagaatctcagtttgttttgtcattaatcaccaaaaccctcaattagggttgattgcacttacaatctcccgctttttggtgattgatgccaaaacaaactagaatagaaataagaattaaaagttacaagtacttgcgagataaaatcttttgtgtatgtgtagctccccctaaatatgtgcatgagttttgcgatattaacattgacttgatatgtcaatttgcaacatatttagagagagagaacaatcaacaccatacacaaaacaatgaggtatgaaacataattggatagaaagagtaaaaatttcacattcaagctcattattgcatagcatataatatgaaaaattctacagctattacaataatgagaactcatctcatcacatcataaaagtgtttatggcttagagccatgcatgcatcatacgagagaccgaatagttattacagaccaagtgttcattacaaaaataaagggtactgcataataaaccttctccccctttttggcaacaagaaccaaaaagagagagagagacgccaatccaacgatcaccagtggggaggaggatgatgaggagcaaagaggtggtgtgccaggtcagaggcaaagtgttcctctccagactaggccggaggaggagcactgccagaagggtcctggggtggagggtaagaggacgattggcccggatccccgtgatacggaggcgggacaaactgctcacgatcatcataataagcttcttcttcttcgtcgacgtcatctgttgtcgtaaaaggcaccccgtatgcctgctggtgtaaggaaaatggaccccgggccttttggctaattgagttttggtgtttgatgaacaacacaatccgtgaactaataagttttctagtgtttgtgttcacaggatgcaaagagaattggaccaaggcaatgaggatgcaacacctcaaaagaagacataaaaagatgcataggagtccaatactcaagaacaaagaagcccgaagaaatcagcgaagaaatccaataaaagggctgtcagccagcgcctggtggcgcaccggacattggtgtccggtgtgcaccggactgtccggtgaggcaccggacagtctgcgcagagaggccgcagacagtcgctctctggctgtagcaccggactgtccggtgtgcaccggactgtccggtgtgccaacgggcagacggcaacggtcggatccaacggtcgactgctacaggcgccaacggtcggctgatgtggcgtgcaccggacatctactgtgcagtgtccggtggtgcaccggactgtccggtgcacccgacgacagaaagctgctgctttctgtccaacggctagtttggggtgtggaggctataaataccaccccaaccggccattctcaagtgtgggagcccaagcaacataccaaggcatatagtgcacatttccaagagctcaaacacccaagtgcttaatagaatcactcggtgattagcgtaggtgctttgcgaagtgcttaggttagttagaccgctttagcgcttgctctaggtgaaccctagttagttgagtgagttttgtaaaaccacacaacccctcggctcttgcgtgagtcgttgtaattgtaccgagtggggcgagagtcttgcgagaccgtgacaaccgcgtttgtgtcacggccgccaccgtgtaccggagggaacgagacccgcggcgtttcggccggaagctcgatagtggagacggcggggagcgtccgagaggagccggaagcggagcaccacttgcgcgtggagaaggcccgtggctctctacggagttactcgaccgtggtgcttggccctcgcgtgggcttccctttgcgtaggggcaccaacgaggattagtcgggaccttgcgtggttctggatacctcggtaaaaataccggcgtcatccacgagagtttgcttctctacttagctctttacattccgcatttatattaagcatttaagtttcaatcttgtagtcatacttatttagtgtagattgaaacttagcctttgcggtagagatagcaacacttagacaaaacctagcttgcacattctagtttgattatttgcataggttttgctctagggatttaattgtggcctagtttagtaaaagttttagaagtcctaattcaccccccccctcttaggcgtcacccgtttcctacaagtggtatcaaagccggtttggctcatttgaaacgctttagcttcaccgctaaaaagagccgacgctttttagaggaagggatggatacccataggccaccacacttcgacggcactaacttcccatattatagtgctagaatggcttgttacctagaggtcgttgatctaggtgtttggagagtcactcgtgacgggatgaaacctctcaagaatcccgagaaacccacacaagtgaggaaaaagaaattcatttaaatgctagagccaaaaattgcttgtatgaatctcttagcatggatatttttaatcaagtatttaccttgagaactgctaatgagatttggctaaaattgcatgagctccatgatggcacatccaatgtacgtgagcaaaaacattgcctagtcttgaatgagtataattcttttgctatgaaagatgatgagcttgttagagacatgtattctcgtttgaatctaattatcaatgagctcaattctattggcattaataagctaggtgatgcggacattgtgaggaagattatctccctgctaccacaacaaagatatgggagcatcatcaccatccttcacaacatggaggatttgagcaacatgaccccgaccattgtgattgggaaaattgcagcctttgagatgtcgcgaaaaatgagtcggggagaggagccaacttcctcaaggccatatgcttttgcatgtgatgaaaggaagggcaaaaagaaggctcccactccaagttcctcaagtgaagaagaggaagaagaagaaagtgatgatgatgaagataatcaaccatgcacatcatcctccgaggacgaagaaacaatccgacgcgtcggaaaggtaatgaggatgatccgcaagattaatctaatgggtgtgcccctgcaggtcgaggatcttctctttaacattgacaggaaaaagcaaaggaagagaggatgcttcgcatgtggggagaagggccacttcagggacaactgtccaaatatggcccagcccaaaaaggagaggagcaaaggcaaggcgctaacaagtgttagaacttgggatgattcttcaagtgaagatgaacctccaaggacgcgcagccaccggtcctcatcacgatcatcacggtcatcacacaaatgccttatggcaagaggtaacaaaagcattccatcctctagtgatgaaagtagtagtgatgatgaaggtgagggaaagccctctctagatgagcttgcggaagccgtagaatttttccaggatgtttgcactaagcaaaaagctcaacttaaaactttgaaaaataagttggttagctctcaaaatgattacaaaggtttgctagaaaaatttgaaacttttgcaaacttaaatagtgagctatcaactaaaattgagctattagaatctagtgctccatccactgctaccgatgatagccttattaaaaagaatgaaaaacttaaggctaagttagctagctcccaagaagctattgaaaatttgctagagaaaatggaaattcttagcatacacaacaatgagctaactactaagctagaaaacattggtagcaccccagcaacatctttagttgaaatacctgaaataattaagaaagatgtttctacttcctgctttgatttaattgatgattctaacccctgcaaccaagtcgttgttgagaatattgttgtagagacatgtacggatgaggttgcaaaggaaaatgaacaattaaagcaagaagtggctcgccttggcaaggctttgtatgacaagaaaggcaaagccaaacaaatccaacctccacaggataacaccactgcgggagtgaacaagcctatggagggagaaactgtgatttgtaggctatgccacaaggaaggccacaagtctttccaatgcaaggcgatgaccggggataaacaaagacaaaagctcaagcaaaagccatcaagcaaaatctcaaacacctacatcaaaaaggtgaacaaaaaggatgctacaccatatttgatcaagaagaaaaataacggaaaggtgatagcaatcaaggccaacaagcaagccaacaaaggaaagagggccaaacgcatctgggtgccaaaggagataatttcaaccatgaaaagcatcaagaaggtttggatcccgaaagggaagtgagtggaccgaaggtcctcgggaaatttggagacttggctaaattgggatgtatatcatgggatacatcatattagatcaagtttattgccaagtgggttagtgaaaattttggacccaaatttcccacccatgactaaggtaactagttttattgtatttctcgtttttagatatgcgtatctatttatcttttatctagtttacctttcttgcctagtattacatttgttatgtacttttgttcaaaatcatgcatactaggtaaatcatatggtaggattgctagtttttaaattcatatacttaagcaaacctacatggcttaaaatgtttagttaaagcacggcacatggcttttatatcactccatagtaaatgatgcatcaattgaaaattttgatttctacaaagtgtatcatttaacttatatgtgccaaaggttggattatggataatttgcccctcttgatatcaaatcaaagtgcatgtctcctacaagtattcaaaacttgtatgcacacctttaggggaggttactctataatctaacactttgagactaacaccttttcaagtctatttcatgtgatagtctcattgtaaggaaaatgaagtccccggagaaagacaacaatcttccactgcaaaatctccaagaactctcatgtctctcaagctcgccatttatcttcaattggtatcttttgagactacattcagtatcatttacatgtcttctccaatatttgattagactatatttcatatcatatgcttccatgttgctaaaaatgcataagtagttaactcatattctgttacctatgcataagggaagtcagtcttttcaaatcatgtcttgcacctctaattttcacatgctttttcctaagtagaggatctctgtcagggggagtatttcttcatctctaaagggggagaaaaactatttctaaaggagaatactcatctagggggagtaatcttttgaggaactccttcaagtggtatcatttaatatccttctagtgatatcatttgatatatttcttgatgagggcaagcttttatttacttcctacttgcttttaatgtcttccttttcggtggttgatgccaaagggggagaagtttagggaccaaagcaatgaaaactatatcaaacaccaaacaccaccaatttaaaattttatatctacaaatggttttttaagtggttttggttatttggtccaaaaataggaagtaagtgaattatggagttagggggaggcttaagtccataatatcacaatgtggggacaatcatgcatcttagcaagtagattgcatagtttcactcaaatacttgtattatttgcttgctttggttgtgttgtcatcaatcaccaaaaagggggagattgtaaggaaaatggaccccgggccttttggctaattgagttttggtgtttgatgaacaacacaatccgtgaactaataagttttctagtgtttgtgttcacaggatgcaaagagaattggaccaaggcaatgaggatgcaacacctcaaaagaagacataaaaagatgcataggagtccaatactcaagaacaaagaagcccgaagaaatcagcgaagaaatccaataaaagggctgtcagccagcgcctggtggcgcaccggacattggtgtccggtgtgcaccggactgtccggtgaggcaccggacagtctgcgcagagaggccgcggacagtcgctctctggctgtagcaccggactgtccggtgtgcaccggactgtccggtgtgccaacgggcagacgacaacggtcggatccaacggtcgactgctacaggcgccaacggtcggctgacgtggcgtgcaccggacatctactgtgcagtgtccggtggtgcaccggactgttcggtgcacccgacgacagaaagctgctgctttctgtccaacggctagtttggggtgtggaggctataaataccaccccaaccggccattctcaagtgtgggagcccaagcaacataccaaggcatatagtgcacatttccaagagctcaaacacccaagtgcttaatagaatcactcggtgattagcgtaggtgctttgcgaagtgcttaggttagttagaccgctttagtgcttgctctaggtgaaccctagttagttgagtgagttttgtaaaaccacacaacccctcggctcttgcgtgagtcgttgtaattgtaccgagtggggcgagagtcttgcgagaccgtgacaaccgcgtttgtgtcacggccgccaccgtgtaccggagggaacgagacccgcggcgtttcggccggaagctcgatagtggagacggcggggagcgtccgagaggagccggaagcggagcaccacttgcgcgtggagaaggcccgtggctctctacggagttactcgaccgtggtgcttggccctcgcgtgggcttccctttgcgtaggggcaccaacgaggattagtcgggaccttgcgtggttccggatacctcggtaaaaataccggcgtcatccacgagagtttgcttctctacttagctctttacattccgcatttatattaagcatttaagtttcaatcttgtagtcatacttatttagtgtagattgaaacttagcctttgcggtagagatagcaacacttagacaaaacctagcttgcacattctagtttgattatttgcataggttttgctctagggatttaattgtggcctagtttagtaaaagttttagaagtcctaattcaccccccccccctcttaggcgtcacccgtttcctacagctggtaccactcgttgacctctggaggaggagggtggagaggtacatcaggagagcggggggcgaagggagtacccaaagcggaagcttgacgacgtaggttgtcgtcagtctcccgctgacgtcgagccacctcatggacatctgcagcaatgtttcggcacatggagaagaatgccgcaaacccgtgggccaagcgagcacccatcccacggccacgacctcgaccacgaccacgaccacgtggcgtgggagatccgcggccaggggaaggatgcgaggcaccggcagcagcagcagcaccagcagacggacccgcagatgtatgagcacgagaactggagggggctttcctgaggcgccctgctggattgtttggatcaatctagaaaggggtatatgactgatgtctggtacctttgtcaaatctgaactgggtcacaacctcaatcatcttcatgataaacggagcatgaagacaccccttcaaaggaaagcaggcgacatgaatgatttcctgccaaatcatgtcaaagacatttatcctttctaagctattgggtttcatgaaagagagcaagaccttgctctccccaagaatgttcatctgattacccccttttggaatgagggtcatcctgcagagggagttgatataacgataatacttatgaatgtttgtcgactcccaatacttcccagactcagaaagatgaagatccttggcttcatctctagtaggctgccggaaatcatgtatcttgatcttgtcgccagagatatcattgtcagaaaaaccaagaatgtgagcaaatcgacgatagctcaccttataccaactaccttcaatgtagaagttcagataagggtagttgtaatgactctcctcgtcagctagctttatccataaagtggagtagaattgagcaataacttcatcattccaatcatattggaatgtcatgatactcttcatctgtttcctttcacaggccctcaatgcctgtgtcatctctgggtccccaatggcttcagaaccttcccagttgatataacgttgatgcaggataggttgatgcttcttggggaggatcacggaattataaaaatccacgtgatgaagtgtccaaaagcggtttccatcaatcctggcatcgcgaatgcgcaatgcaggattttggaaacgaagatcctgaagtagagcagagcctccactggtagtgaaatcagtgactggctcattgccagcacgccgagcctctgcccggtggaggaccaacccacgaatcacaggggcgtgggcagggggaagatcaacttcatcatccttcccgccttcatcatcacttgtggcctcccacgcctgcggattcgtcgcgggtcgggaccgaccggaaggattccgggttgtccgaccgcgagcactttgagacccggaggcctcagcaccttgcatcacatttccgcttccgcgccctcgcttggaccgatagcgtgggggagtatctccatggatttcctggtcatctgaggagtcggattcaaccacggacgggttcctccgacgcaccattctaagaaataagaaatagaacctatgatgagcaaggatcaaactcgtttgagtagaaacatataagatattgagcatgcacttcaaccgttcatatgagcggttcaactacaacgaacaatatcaaatcgctaatctctaacaatgtttgtgacaaaggaagataatctaagtgttgcaatcacttaaactaaatgtacccaacgaaggatacattagataatcaagaacgcggaggatcgagtataagaaaatgaaatagggcaatacctcgatccggagattgggtcaagaaatcccaacgagattgaggaagatgatggagaacgccgggatgaacggatctccaacaactcttccaaaggtgagaaggcacaagtgagtttttggagtggagtgtgaaggagagagaggaggaagagagggcggcggcggctggaaaatgagactgagaagggaagaggagagagggagagaaataaaagggggaaagtcggccgccagaaaacagaaaaccggttcaaccggttcaaaaaccggttcaaccggtttctggtcaaactgtgcagtaacagcgcgcagaaaacggtgttgactgcgcgaaaattctggcagtctgacagcacagactgcaaaactgacagcacagactgcacagctgtcagcgcagactgcgcgcagactgacggcgcgaaggccaaaaccggttcatccggtttttataccggttcaaccggtttccaccaggggaaaactggttgagtggcctactcagccggtttactcaactagtttccagaaattgcccggaagggctataatagcacttagcaaatatgacatgagatattttaatgataaaaaagttatttctcatttcatattgctcaaacaatcaattttcatccatcaaatttgatcaaaattttagttattaagtcacgtttcgagaatccaagatatttagttcactcctaagaaaacaaaacctagtctcatcaaggggtttagtgaagatatcggctagttggttttctgtgctcacatgaaacagttcgatatctcctttggcttcgtggtctctcaagaaatggtgtctgatgtcaatatgtttagttctagagtgttgcaccgaattgtttgcaagttttatggcactctcattgtcacacaaaagtggaattttgataaactcacaaccaaaatctctaagggtttgcttcatccataacaactgtgcacaacatgccccagctgctatgtactcagcttctgcagtggaaagtgcaacacaattttgtttcttggaactccatgacactaaggaccgcccaaggaattggcaagtctcagtagtgctttttcgatctactttgcaaccggcataatctgagtcagagtagccaagcaaatcgaaaagggagcctttgggataccataatcctaggttttgggtgtggactaagtatcttagaattctcttaacggctacaagatgacaatctttaggatttgcttgaaaacgtgcacacatgcaaacactcaacattatatcaggtctagatgcacataagtaaagcagtgatcctatcattgatctatataatttttgatctacaggtttaccttcctcatttaggtcgagatgtccatttgatgacattggagtcttggcatgttttgctttttccatgccaaacttcttgagcatatcttgtgtatatttggtttggcatagaaaagtaccttccttgagttgtttgacttgaaatcccaggaagtatttaagctcgcccatcatagacatctcaaacctgttcgtcattactttgctaaactcttcacaaaatttttcattagtactaccaaatataatgtcatcaacatatatttggcacacagataattcattgtcaacttttcgagtaaataaagtagagtcagcttttcctattgtaaacccattcttaattaaaaaatctttaagacagtcataccaagctctaggggcttgtttaagcccgtagagtgccttgtgaagtagataaacatgatttggcttctttggatcttcaaaacccggtggttgctccacgtatactctctcttgtagtggtccatttagaaatgcgctcttgacatccatttgatatagcttgaaatcatggttagtagcataggcaattaatattctaattgattctaaccttgctaccggcgcatatgtttcaccaaaatcaagtccttccacttgagtatagccttgggcaaccaaccgtgccttgtttgttgtaaccacgccatgttcatcttgtttgttcctaaagacccatttagtcccaatcacattttgtttgggtctttggactaaggaccagacttcattccgggtgaagttgttcaactcctcttgcatggcaattatccaatccggatcacccaatgcttcttcaaccttaagtggctcaagagaggaaacaaacgagtaaaattcacaaaaattagctaaacgagatcgagttgttacccctctcctgatgctacccaggatgttgtccaccggatgatccctttgaattgtttgatggactctaggatgaggcactgatggttgtctttgtatttgcccctcctcctcatccacttgatcaagaggcacttcaccatcaatactttcttgttcatcttctaccactgttggcatcctttgatgattttcttcatgtcttggatgacttgaggttgatgggtttgcttgggtggagactttgtcactcaccacccttgcacccacatcaacaacctcattggtcatccataaggttccttcctcatcatccttttcttgaggtctcacctcacctattgcaagtttctttatggcctcacaaggtagttcttcatttcctgcagtgtcattagaaacatgcccttgcgagccattagactcatcaaatgtcacgtctatcgctatttcaacaagaccggtggtattgttgaaaacacgatatccatgcgcatttgatgcataaccaagcaagaagccctcgtccactctaggagcaaactttgagctcttgactttcttgttaagaataaaacatttacaaccaaatactctaaaataatcaactttaggtttgttaccagtgagaagctcataagcagtctttttgtagatcttatgaagatagagacggttgattgcatgacaggcggtgttgatcgcctctgcccaaaagttgtcaggtgtcttgtactcatccaacatggttcttgcagcttcaattagagttcggttctttctttccacaacaccattttattgtggagtgtaaggcaccgagaactcatgtttgattccctcttctcctaagaattcttcgacacctgtgttcttgaattccgtcccattatcacttctcactttcttgattttgagctcaaattcattttgagctctcctcatgaatttcttcaatatttcttgagtttcacctttatcactcaaaaagaaaacccaggtgaatcgagaaaaatcatcaacaatgactaaaccatacttactaccaccaatgctaatgtaggccacaggtccgaagaggtcaatgtgaagaagctccaatggcctctttgttgtgaccacattctttgattgatgtgggactccatgttgctttcctgcttggcatgcgccacaaaccctatctttctcaaatacaacatttgttagtccaatgatgtgattatccttttgaagtttggccaaattcctcataccgacatgggctaaccggcgatgccatagccaacccttgtcggactttgccactaaacaagtctcaggcgtcactttacttgttgtgaaatcaacaagataaagtttgcccttcaaacgaccagtaaaggcaactgaggagtcctcccttctaaggatcttcacatccacatcagaaaatggacaattataacccattccacaaagttgtgaaacggacaacaaattatagcttaaagaatctaccaataaaacatttgaaagtgattgttggtcagagataggaattttaccaataccaatcaccttactcttgccgctatctccaaacacaatttcttgtgcttcttgagttagctgcaatgaatgaaacatgtctttctccccggtcatgtgatttgtacatccactgtcaagcacccaacttgacccaccagaggagtagacctgcaaaacaagtttaggctatgcttttaggtacccaaattgaattgggtcctgtggcagaaccttccaagttatcgggcccacatgcacctgtccttgtctcaaagacctcagacagctatgcatgtgcaccagataacttaacaggatccgtctgattgcccaaggacatcggataaaccacttacaaccagaaccgcgggattaagtaacacaaatcacacacacaacatttttgcagcggaaatcttattaccaaattttacaggttataaaaaaaatatttacattactttatcggagtgattacaaaagtataagtttgaaatacatgctagctcaagtgaccatcctcaataagaagtatagaagggttacttagacttataagaaggccgagcccaccggcacttaacaccatcaacaacagcacaaagttaaaacctgaaaaacaacagggaataaaaccctgagtatggaattactcagcaagtcttacccgactaaggaaaagactctcaagggtatgctggataaataggagccaaggagaggctttagcaaaaatcaacttatacttttgcagaagtagcttactaaagtgagtccttacttttaatcttttaacgccatattaagtattaatagactctatttgcatctagtctattttcaatcatctcatcaatacaacatcatttttatccataatgttcacatcctgactttaggttgcagggcagtgaccaagtcttcataaccgcgaaggtacgacgatccgaatcgattatactcagctgaggatctccaatcacacgacatatgtagcacttaacccttgcatatgtcaacccgccaccggggttcttaagaccggatcaggttcacgcaaaccgagagcacagatacaccaccgtccagcctcttgccacggagggtacacgctactctcgccaccgctccacgtccatttcgtgttatcttattccggccttagtctgcccgaggcaaggcttacccatgacgaggcatgtgaccagttaaagggtcctcgatcatcaagcctacatacgcgttaatccttaatcaacctgggtagaacatcacctgttcctaacctaagtctcgatttacatacttccatccttaggattgtttctgttcccaaggatgaaaagagcatcacagggagctttgcagtaagatcccaccattgctccaaatgaaaatattcttgcaggtagaagccatcctttctcgagttaaattaaggataacctctatctacaagatctaagcaaggctaagcatttttgtaaatcatattttgatacttcaccgaagtatctataaaggtatggatatcaaggaaagcaatgcatcaaagggtttcaagcaattcctatgaacctaatgcacatttcactagacttaagtgtgcgaaaagtatttaaaaacacaaggaaaggggttgcatgcaccggggcttgcctgagtaacactaggttagtgttgttaggtgacgtccgcttgacgagtatccttcgaccgagcacttgcttgatttaaccgtcttcaggttgattcatcagcttcagcttgtagattagcccacgcttggggtcggcttggttcttcttccgcatcacgcgattatttatcgtacctcatgagatgcatgatgcacatgtatgagcatatgtataacgagtataatatagataatctacgctaaaaagcatgaaacacttaaaaccaagcattaagcaccatggatatcacagcaggacatcgactatatccattaatcaaattgacatattacactagaaaatctatttttattcttagctttttattaactctctaaactgtgtaacttaattagttgatttagcgagctatctaaatcaatcatcacaatatacgcatgctaaattaataatatttattgtgaccaacaattctatttaatctatttatagacctagttaatgggaatacgaaccaacttaccctgactaattcgacgcgatagtcgcaagcacgactacgggttccggttgatgtcatccaggagccttcttttcttcggtaattaattgctgaagatcttttcttcgattgaataatttcgacgaattgaacttgagtcgcgcaggatgtccgagctttttggtcgcgcacttggtgaatatcacgctgctggcttcgtcttcactcgattcttggaatttttgatgacgcacggaacgacgacgacacaggagggtgacgtatatagagctacacacgcgacacgatgacgaacgatgctgaccagcggaatcgatgacgcgatgagaattaaggccaagcgagccgagaggacgcaccggcgagcaggaaaaagactcgacgcgggagtttgacacgcacgcgaagcctatcacccgcgacaacactatgatggcgatatgagcgaacgcgaatcggcgcgggccaaacaccgtataaccatggcagcgacttgggcgagatccaaactagagcagcagcacaccgacaagcagggacgactggcaaactccggtttaggtgaatggaacgcgacacagggagctggtgcgcacgtagggactcgacgacggacagcggtcatggatgacgtgtcgcgcggacgaccgagcaggacacgaactggacagaaccgagcgcgcaggctccacggcgaaccgagaaaccggctacgcgcaggggcagaggaccgcgcatgcaaggcgagcagcaaggcgacggcgcgcaggaacgggaagcctcgacagggcgctgtacggaggagttcggctgggactcggcagggaggagacctcggctgggggcttggcgcgcggcgaagcagacagcagagggagctcgcggccatggaggaataggggtgcgacggcaaggagctggggtcaagcagagagaaaacgagagaaaggaaaaggagcaggacgccatggatggagtctgcaggggattctgccgggctgggcgacagcgcagtggagcagagagtgcgcgcaggcaaccagaagccgggcgagtgggagggagaagaccccggacgctgagcatggagggtgaccgacgctggagatccggccggcgagcaaaggggcgagcagggcgggtgccatgggagcaccgcgcgcagaccaaggaaaaacaggggacacgccatagctgagagatgagctcggctgggagctacgcacggtcgggaggaggaagaagcagagcgcgcgccggaggagcagaggagatggacgcgcgcgcaggagctggagcagaagcaccgcgcaaggaagaagcttggctgccggtaaaaataaagagcttcaacgtgcgagagaaatatcagagaaagggatagcgacgagagacgatggagatgagcaggaagggcggcaggatttttctggcggctaaaagatttcttctcaggcacaggcgacacaaggataacgatggcgtttttttttccaagtaccgagcgcgcgtgtgggaagatgaggccaagaaagatatttcttttttctaaataattaaatgcaaatatctaatgtctaggatttgcgagagtttaaatgacttggttccaatcatatttcagactacgcattttattttctgtattacgaaataggacaccgaatctgctaacaattgctctggttttggttagttcagattcattttgtttaaacagcctgctttagtaatgtctaatgaattcgtagagaccgctcgaacaagagcaaagtaattaggcgacgtttccaatttccttaatcgattgattgtagactggcactagacttgacactttataaaataaatttttaatgtggtaaactctcagagtcatatgaacctcaatcagttatttatatcagaaagtgttgatctgagcgagaagcaataggtcgaattaaactgattctcgctacgatagtttgctctgcctgatttgactgaagttagtcgaaaacaatccgctaatgtacacgcgatttcgtcatcagaacatcgtgcagacggataaattggatcctaacctcgcgcacgatttctctcagacatcgcgcgacacaaattattttgccccgacattttagttgtcgagttcaaattaatttgcccgggataaaaatcacccagtggttcgagcttccgaattcatattcgcgcgagcgatgaatttttaataatcaccggacgcatcgattttcagaacgacgatgttccgatcatcacgaaaatttaggaagagcccggatagatacaaccgatgtcgaactcacgacaaacggatcagatgcgatattaaaattgcgatggccgaagatgtttaaaatttaacatccgttttatccactgattacgtgcttaaatccgtactcatcgtcgagcggaatataaacacctggggtgttacagccctctccccttaaaagaatctcgtcccgagattcagaatgaaagacttctaagagtagagaagcatgtaacccacatccatatcagcggtaactaaggcagtttcaagcaaaggcgagtgtctcagaatgtggtttctctagcggacataacatatatcgccttaggctaatttagagatgtccaccaatagagacgctgtctgccagaagaacacataaggttccatgtgtgcagtttgctttttctgatgacactgtactatctgagtctgttgagtgagcaactaatacgcgattttacccaaacagaatcagatgcaacctcttgggtaaaacacacagaaagaggtttaccaataagtggtcgcgataggttcatagcacacgagacgagtgtggatgttgaatactgtcgcggttaacatgtggttaacccgagaattcaagtccacgaaagatggtatagattcgagagaatcaccagcggaggggtctgtagatacgaactttacgaccagtccattttatccagcactaatcatggctcgacatggtcacacatgctggaaaagcacacgtgaggcgatcgagacacgactagagcgatggctaggtggttactggccaacttaatctcgattcatataagtgctttcttcagggtgtttttaaccagagtgagtttagacaactcgacaaaacgatctctaaactcaacctttgatcacaaggcagttacaacttagtaaaaccaacttgttgaactactttcgacattgagcaagtcctctcagtaccatcggtaagccaacggtcgagagctcacatttgctagcaaaaggtcatgcatttgggtagaaatccatttggtcatgttgttcatccgtttcttcatgcgagatgaattatccacttggttagggaatacatggattaaataagggagcgaatgaacaaattcctgcatctcagcagcaggagaaacacatctccattttgagagctaatcagttgttttccaatattaaaaagctccaaggattcacctttcacaaaggatgtaaagggaacttgtatgtgtgaagtcaccatcaaagtcaaggaaaagaaaccatacaagaaaatggtatgccctttttatccaatggagatgataaatgttgtttgatcacttgacaaacaacctagaaattgtttcaaagaaggagtccacggaagatcacacatcggtgtagttccacaatggatcatgactagagacttcgataccagcatgcgccaagcagcagaatcctgtgtgcacattcacaggaggctcttagtttcgccgtggcaccataagtcattaatcgagacgccattatcgaactggcaccaataatgaatctcacgtggtaagaataatttgcgcaaagataacatatcaatatagtctaataatggattatgactactaacggtgataccagcggatgccaagtagcgcaaccatgtgtgtgcatccacaggaggccctcggtttcatcgcagtgccatcggttttagtcataacaccattgccagacgtcaccaataagaaatctcgcgtgacaccattggattgaacaaaggtgacaatatataaagaaatactccacctataaaaatggttacaagtagagaccaaatagatcatggcccgatgaaacgaacaaagtatggccataacctaaacttgttaatgaagggagtacgatgggagactgttaatttagccacaagcatatttctatgcccatcagatggattacaagtcaaggattagtatctgactagatacgcagggaaaacaatcacaaggttaagtgggtatgccttcgagaaagatggggaactaaaggcatcaaacgaaggaaaatgattaggtatgactttcctaagttaggttgataaggcgacaagatgatcaacaaggagaggccgaatacaatagggacctcaacctgcatcaactgaacaagggaatggttctaaaaggagacatgacttgagattcttgttgtaagcctatgtacaatttatgtccaacaagtaatttgtctaagcatttatttttatgtgtttggtcatggagtgataacggagaattcaaattttgggtcatggttcaccaactaataacatggcctaatttccggtttaggcaaacaagtcactaaccttctatcgacacatcaagcacaagggcaaacacatttgcactaatggtcaaattatgaaaagctaaaggcaatctaaacctgtatccctaagacaccacatcattcacaatcaccaagttttggaataaaggtgagagaagcattttgggtgtataggtaacaaacataatgcaacaatcaggatgcatgctcgtcctacacgtcctcacgagttttgccaacataatgtggcgatagcgttctatatcggtggcatacttacgaatctcacggtaatttgctagtcgtcagctacacatacgttttcgaggttagtgtacctgcagaaaattccattacaacccaatttcccataatgcaattcatacatgacagtttatcacaggttatactccatatatcgctatatggaggccagctcatcattaagcgctgagccatgcataggcgccgttgccacactttaacaatagggcaactcattatggtaactcaccttcttacctgaacgtaggtgcgttgttacaagtacattacacttctcagtattcccatgtctgtatacccttacacatccatggggtactgaattcccgaaaaagtaagtactccacatcgcagccttcatatatacatatgtagaacatgtatataatcaggcgctacaattaagcacttccctagaccgacggttgttcggtcatgctctcacaactcaccttaccttgggcgtcgatccattccaaacggaatggttttcaaaaataacaatacacatgtatgcaatacccacccggttgtgggttagtggttttcaactaagccacctaatagtccttagtttagggcttaacagaggatgtcgctagcattatagtttttttttcaaaactatttttcaaagccaaacaatatgtttagttgaaaataggtttttcgaaaccaaaacttttgttttgaaaatatgtatgtgactgtatatacttaatccagctccgataccagctgtggcagaacctcccaagttatcgggcccacatgcacctgtccttgtctcaaagacctcagacagctatgcatgtgcaccagataacttaacaggatccgtccgattgcccaaggacatcggataaaccacttacaaccagaaccgcgggattaagtaacacaaatcacacacacaacatttttacagcggaaatcttattaccaaattttacaggttataaaaaaaatatttacattattttatcagagtgattacaaaagtataagtttgaaatatatgctagctcaagtgaccatccttaataagaagtatagaagggttacttagacttataagaaggccgagcccaccggcacttaacaccatcaacaacagcacaaagttaaaacctgaaaaacaacagggaataaaaccctgagtatggaattactcagcaagtcttacccgactaaggaaaagactctcaagggtatgctggataaataggagccaaggagaggctttagcaaaaatcaacttatacttttgcagaagtagcttactaaagtgagcccttactttcaatcttttaacgccatattaagtattaataaactctatttgcatctagtctattttcaatcatctcatcaatacaacatcatttttatccataatgttcacatcctgactttaggttgcagggcagtgaccaagtcttcataaccgcgaaggtacggcgatccgaatcgattatactcagctgaggatctccaatcacacgacatatgtagcacttaacccttgcatatgtcaacccgccaccggggttcttaagaccggatcaggttcacgcaaaccgagagcacagatacaccaccgtccagcctcttgccacggagggtacacgctactctcgccaccgctccacgtccatttcgtgttatcttattccggccttagtctgcccgaggcaaggcttacccatgacgaggcatgtgaccagttaaagggtcctcgatcatcaagcctacacacgcgttaatccttaatcaacctgggtagaacatcacctgttcctaacccaagtctcgatttacatacttccatccttaggattgtttctgttcccaaggatgaaaagagcatcacagggagctttgcagtaagatcccaccattgctccaaatgaaaatattcttgcaggtagaagccatcctttctcgagttaaattaaggataacctctatctacaagatctaagcaaggctaagcatttttgtaaatcatattttgatacttcaccgaagtatctataaaggtatggatatcaaggaaagcaatgcatcaaagggtttcaagcaattcctatgaacctaatgcacatttcactagacttaagtgtgcgaaaagtatttaaaaacacaaggaaaggggttgcatgcaccggggcttgcctgagtaacactaggttagtgttgttaggtgacgtccgcttgacgagtatccttcgaccgagcacttgcttgatttaaccgtcttcaggttgattcatcagcttcagcttgtagattagcccacgcttggggtcggcttggttcttcttccgcatcacgcgattatttatcgtacctcatgagatgcatgatgcacatgtatgagcacatgtataacgagtataatatagataatctacgctaaaaagcatgaaacacttaaaaccaagcattaagcaccatggatatcacagcaggacatcgactatatccattaatcaaattgacatattacactagaaaatctatttttattcttagctttttattaactctctaaactgtgtaacttaattagttgatttagcgagctatctaaatcaatcatcacaatatacgcatgctaaattaataatatttattgtgaccaacaattctatttaatctatttatagacctagttaatgggaatacgaaccaacttaccctgactaattcgacgcgatagtcgcaagcacgactacgggttccggttgatgtcatccaggagccttcttttcttcggtaattaattgctgaagatcttttcttcgattgaataatttcgacgaattgaacttgagtcgcgcaggatgtccgagctttttggtcgcgcacttggtgaatatcacgctgctggcttcgtcttcactcgattcttggaatttttgatgacgcacggaacgacgacggcacaggagggtgacgtatatagagctacacacgcgacacgatgacgaacgatgctgaccagcggaatcgatgacgcgatgagaattaaggccaagcgagccgagaggacgcaccggcgagcaggaaaaagactcgacgcgggagtttgacacgcacgcgaagcctatcaccagcgacaacactatgatggcgatatgagcgaacgcgaatcggcgcgggccaaacaccgtataaccatggcagcgacttgggcgagatccaaactagagcagcagcacaccgacaagcagggacgactggcaaactccggtttaggtgaatggaacgcgacacagggagctggtgcgcacgtagggactcgacgacggacagcggccatggatgacgtgtcgcgcggacgaccgagcaggacacgaactggacagaaccgagcgcgcaggctccacggcgaaccgagaaaccggctacgcgcaggggcagaggaccgcgcatgcaaggcgagcagcaaggcgacggcgcgcaggaacgggaagcctcgacagggcgctgtacggaggagttcggctgggactcggcagggaggagacctcggctgggggcttggcgcgcggcgaagcagacagcagagggagctcgcggccatggaggaataggggtgcgacggcaaggagctggggtcaagcagagagaaaacgagagaaaggaaaaggagcaggacgccatggatggagtctgcaggggattctgccgggctgggcgacagcgcagtggagcagagagtgcgcgcaggcaaccagaagccgggcgagtgggagggagaagaccccggacgctgagcatggagggtgaccgacgctggagatccggccggcgagcaaaggggcgagcagggcgggtgccatgggagcaccgcgcgcagaccaaggaaaaacaggggacacgccctagctgagagatgagctcggctgggagctacgcacggtcgggaggaggaagaagcagagcgcgcgccggaggagcagaggagatggacgcgcgcgcaggagctggagcagaagcaccgcgcaaggaagaagcttggctgccggtaaaaataaagagcttcaacgtgcgagagaaatatcagagaaagggatagcgacgagagacgatggagatgagcaggaagggcggcaggatttttctggcggctaaaagatttcttctcaggcacaggcgacacaaggataacgatggcgttttttttccaagtaccgagcgcgcgtgtgggaagatgaggccaagaaagatatttcttttttctaaataattaaatgcaaatatctaatgtctaggatttgcgagagtttaaatgacttggttccaattatatttcagactacgcattttattttctgtattacgaaataggacaccgaatctgctaacaattgctctggttttggttagttcagattcattttgtttaaacagcccgctttagtaatgtctaatgaattcgtagagaccgctcgaacaagagcaaagtaattaggcgacgtttccaatttccttaatcgattgattgtagactggcactagacttgacactttataaaataaatttttaatgtggtaaactctcagagtcatatgaacctcaatcagttatttatatcagaaagtgttgatctgagcgagaagcaataggtcgaattaaactgattctcgctacgatagtttgctctgcctgatttgaccgaaaacaatccgctaatgtacacgcgatttcgtcatcagaacatcgtgcagacggataaattggatcctaacctcgcgcacgatttctctcagacatcgcgcgacacaaattattttgccccgacattttagttgtcgagttcaaattaatttgcccgggataaaaatcacccagtggttcgagcttccgaattcatattcgcgcgagcgatgaatttttaataatcaccagacgcatcgattttcagaacgacgatgttccgatcatcacgaaaatttaggaagagcccggatagatacaaccgatgtcgaactcacgacaaacggatcagatgcgatattaaaattgcgatggccgaagatgtttaaaatttaacatccgttttatccactgattacgtgcttaaatccatactcatcgtcgagcggaatataaacacctggggtgttacatgtcctaaagtgttagttatagccttaggtacccacacacttcttttcatgacttttcttttagtgtaggcacccacatatttcacaaccaatttccctaaatcccaagtcaacatataatcacaaagataagagtgggaaatgggagcattaaattgttgtccacttgaggatcccacttccttcatcttactctttgtggaactcaagtttacctttacctgaggtgacttgtcatttgaggagtgaatcctccccaaggcatcatatagggtagttccctctatgaacttgggggatctccaccccttatgcactgtgctagggttttccttggatgagttgaacccaagccccctttttccattgttgggcttaagggacttgtacttgggttcaactttctttaacccatcattgctagagcatcttttcaaaatttctttgaccttcacctgtgggctattcttccttgcatggttagttagacaacaagaagcatgatattttgcacaatgtttgcaagaattatcatttgagctagacttagattcaaatactaaagatgaggcattgatattcttgcaattttcaagttgcacttgaagttcttgattttgaacattcaagcttaacatgcttgtttcaagtgcattcttttcatttgcaagattagttatagaggttttcatgttaattacttctttatctttattctctatagttatcttgactaaagagacttccttagtcaagacatctagcatttcatctttattgtgaatcaactcttgaagctctaggtttctttccttttcaaggataagcaagtcttcttgagcatcaagagttgcttttcttttatctagcttctccattaatttggtgataacattgtatccattcaagccaaattctttaatcattttatttttcatggcaatttgatcatcatcatgatttgaaaaatcattactaaataaggttaccttatctccctttgccatgaggcaagttggagtgtaggagtcgtcttgtaggttggtgaagagttgcgcgcttgatgtagattggatggccacatttgccaccacttcctcttcctcggagctagaactctcttcatcggagttccattcttcaccaatatgggcttgaccatacttcttcttcttgaagtatcccttggtcttgcctccctttttaaacttgtccttcttgtattccttcttggcttcttgttccttcttgttaggacaatccgctatgaaatgaccggtttggccacattcatagcatgccctcttctttcctttcctttggaacttgtcattcttccttacaaatttcttgaatgttttgatgaacatagctgtgtcttcatcacttgagctatcttcatcacttgaggtctcgaccactttctttgctttgtggtctttgttcttcttgaggttgtcttgttcatttgtgatcaaggcatgagagtctcttgtcttgatgggggcttcttcggactcgtgttgttcaatttttgcaaataattgatgaggtgtcatatcctcatagtcatcacgatcccttatcatccttgcaagactcttatccttttctttataagctctcatgaacaatcttgtgaccttggagtcactccaatcttcactcccaagtactcttattttgttgaccaacaccatcaaccgatcaaaaagtgattgaagcgactcaccctttgtccaatcatatcttgcaagctcactttccaaagcttcaactctatgtcttttggctttgggatctccttcatgtgacattttaagaatgttccaaatgtcacgggcatcttctcttccttgaactttctggtattcttccggacaaagacttcctttaattatgctcactgcttgagcatttcgatgaacctcttgcatcatttccggagtcatctcttctccttgggcgggcttatacatacctacattaacaatctcccaaagactaggatgcacaccgattaaatgcgacttcatcttgtcggcccactcatcatagttcaactcactaagagttgataactttccaagtggggcggaagagaagttgggaatataatttctagagtaatcgaattgaactttgctaaattcattacctttgcttttggtagatgatccttcggtgttgagacttaccttgctcaataccttagacaccaaaaggtccactagatcgtcattataatcaaatgttcccttacctttatcttcttcggcctttcttcttgattcttcttcttcggcctttttcttagcatcttcctctttcattttgaggaacattctctcggcaatcttcatggcgaggtcgaggaccttggggtccacttcctcaccggaagatgtgacggggatttcctcgaggagaggatccacatggtcccgttgtgtagacatgatcgtttcctcacgcgattaagcgtaaagcgaggcacgaagctttgataccaattgaaagtagcctagagggggggtgaataggctacacctgaaaattttcactaaaaacttcgagataggttaaactaaagttgcactggtgcaaaccggttcagtcgattttaattacaactgaacaagtttgaacctgctcaacttaaattagataatctgttgaacaaatacgaagtagtgaagaatatagctaaagacttgccctacacaaaatctactcgaatgaataatatgacccaaccaccgaatataaagcgcttgacaagaacacacaagaacacgcgatataactcgaggttcggcaaccaccacaaaggtgtcctactcctcgttgaggaacccacaaagggtcgggtcttttccaaccctaatcctccacaagccgaccacaaaggtcaaggcaatctcttctcaaatcagctcaaagagcgggtgatacaaacttcttggggtcgtccacaaatttggagactcccaagcaacctctaaccgtcaaggaacacgaggttccaagagtaacaaatccacacacggttaagtttgcaacgagctcaagaacaaagagaatgggagaatcgagatgaaattgacagcgagttcgatcgagttcacctcacaccaagggtccttcaaatgattgaaggagatgcgattgcgggtgtgaaaggtgaaatgaatgcgcttgtttgaaggttggtcagccaagaattcgtgggagagacaggagtaaatgagagagagagtgtgagggggtatataaaggatcccccaaaagctggcagccgttgggagaaaaagagtaaaaaccggttgaaccgattttcagaccggttgaaccggtttctaccagggggatcccggtccactgagctactcagccggagactcgaccggtttcaaaaccggctgagtaaggaaaaaattcggctcaaccggttttagaaaaatatctgctgcgacttttctgacagctctgactgtcagacaggtcagagcagatgtggcaggtgaacagtaccgaaaccggttgaaccggtttcaggaccggttgaaccggttttgggggctgaaaccaaattttgagtattttgaagggaacaaaagtggagtatttgtgggaagtaaaatttgtttttctcaaggnnnnnnnnnnnnnnnnnnnnngttctccaagaagttttcaaaagattttgaacttggttcatttcacaacttacttaaccgtcgcggatccctcttaattgtacggcgattcctatgactcaagaattataaatttagcaccgccgttgtttctaggcacttggagcacgccatttgatgtggaattttaaatccgttgtgctttatacttttatgcttgtaagatctgtgcttctcctgtctgtagaaatactgtgtacatactaggagcaaacttgttagaatctcagtttgttttgtcattaatcaccaaaaccctcaattagggttgattgcacttacattgatgtaggaggtgaacatcttcttctcccccgtcatatggtttgtgcatccgctgtcgataatccagcttgaacccccggatgcataaacctgcaaggcaaatttaggcttgggacttaggtacccaactcttgttgggtcctacaaggttagtcacaattgtcttagggacccaaatgcaagttttatcacccttgcattttgcccctaatttcctagcaactatcttcctatcctttctacaaatagcaaaggaagcatttaaagcatgataaattgtagagggtccattcataactttcctaggaacatgaacaatattctttctaggcacatgatgaatatttttcctaggcatatctctaccatgcatataggaagaactagaagcaaacatagcataagaatcataggcatgtgaatcaaaagcattataagcattacaactcctatgagactgtcttctatcatgatacataaaagcatggttctttttagcactactagccatagggatcttccctttctccttggcggggatgggaggcttatggcttgttaagtccttggcttccctcttgaaaccaagtccatccttaattgaggggtgtctaccaatcgtgtaggcatcccttgcaaattttagcttatcaaattcacttttgctaatcttaagttgggcattaatactagccacttcatcatttaatttggaaattgaaactaggtgttcattacaagcatcaatgtcaaaatctttacacctattacatgttgcaacaatttctacacaagatgttgatttactagctatttctaacttagcattcagatcatcattaatgctccttaagctagaaattgtctcatggcaagaagataattcacaagaaagcatttcatttcttttaacttctaaagcatgagatttttgtgcttctacaaatttgtcatgttcttcatgcaacaaatcctcttgcttttctaaaagcctattcttatcattcaaggcatcaatcaattcattaattttatctaccttggttctatctaggcccttaaataaacatgaataatctatttcatcctcatcactagattcgtcctcacttgaagaagcataagtagagtttcgagtacataccttcttctcccttgccataaggcatgtgtgacgctcgttggggaagagggatgacttgttaaaggcggtggtggcgagtccttcattgtcggagtcggacgaggagcaatccgaatcccactcctttccaagatgtgcctcgccctttgccttcttgtagtttttcttcttttcccactttccactcttcttttcatggtcactatcattgtcgggacaattagctataaaatgaccaatcttaccacatttgaagcaggagcgcttccccttcatcttgttcttgttggggtgctccttgcgaccttttagcgccgtcttgaatctcttgatgatgagggccatctcttcatcattaagtccggccgcctcaatttgtgccacctttctaggtagcgtctccttgcttcttgttgccttgagagcaaggggttgaggctcattgattggaccattcaatgcgtcgtccacgtatcttgcttccttgatcatcattcgcccgctcacgagctttccaagtatctcctcgagcgtcatcttggtgtacctaggattctcacgaatattgttcacaagatgaggatcaaggacagtaaaagaccttaacattaggcggacgacgtcgtggttcgtccatcgcgtgcttacatagcttcttatcttgttgacaagggtcttgagccggttgtacgtttgggttggctcttctccccttatcatcgcgaatctcccgagttcgccctccaccaactccatcttggtgagcattgtgacatcgttcccctcatgagagattttgagggtgtcccaaatttgcttggcgttatccaagccgctcactttgtgatattcatccctgcacaatgaagctagaagaacagtagtagcttgtgcattcttatgaatttgctcattaatgaacatgggactatccgtactctcaaagtgcattccactctctacaatctcccatatactaggatggagagagaacaagtgactacgcattttgtgactccaaaatccgtagtcctctccatcaaaatgaggaggtttaccaagtggaatagataataaatgagcatttgtactttgaggaatacgagagtaatcaaaagaaaagttcgaattgaccgttttcttttttctcgtagtcgtcgtcgtccttttgggaagaggaagattcgtcgctgtcgtagtagacgatctccttgatgcgccttgtcttcttcttcttcccgtctcttcttttgtggctcgagcccgagtccgtaggcttgtcatctttcggctcattgaagatagactccttctcgttgttgttgaccaccatcccctttcccttaggatccatctcttcgggcgattagtcccttcttgaagagaacggttctgataccaattgagagcacctagagggggggtgaataggtgatcctggaaaacttaaaacttaagccacaaaacttggttaagtgttagcacaataatcgccaagtggctagagaggagtctcaacaaaacacaataaccacaaagatatcaatcacagagatggcacggtggttatcccgtggttcgaccaagaccaacgcttgcctattccacgttgtgacgtcccaacggacgagggttgcaatcaacccctctcaagcggtccaaagacccacttgaataccatggtgtttttctttgcttttcttaatcccgtttgcgaggaatctccacaacttggagcctctcgcccttacacttgaagttcacaaagaagcacgaagcaagggagggattagcaactcacacaagacacaaagatcacagcaaatacgcacacacaagacccagacttgagctcaagagactagcacactagaacggagctcaaatcactaaaatgtcgaacaagtgcgcaagaatgaagtgtgagtgatcaagaatgcttaggaatgcttggtatcctcctccatgcgcctaggggtcccttttatagccctaaggcagctaggagccgttgagagcaatccaggaaggcaattcttgccttctgtcgcctggcgcaccggacagtccggtgcacaccggacactgtcccatgcccgatttctttccttctatggcgaagccgaccgttggcagccttggagccgttggcgcaccggacatgtccggtgcacaccggacagtccggtgcctccttctagccgttggctcggccacgtgtcccgcgcagatcgcgcggccgaccgttggcccggccgaccgttggctcaccggacagtccggtgcacaccggacagtccggtgcattatagccgtacgtcgccggtgaattcccgagagcggccagttcgctcgagccagcctggcgcaccggacactgtccggtgcaccaccggacagtctggtgctcctagattgagcagagtcttggctgctcgagccaagacaattccaattcgatttttcctgtttccagcacttagacacaatacattagtctctaaaacaatgtactaagtctgagaaacatacctttatccttgatttgtactttgtccaccattttacacttaggcacttgtgttggacactaaatcaccaaaatacttagaaatggcccaagggcacatttccctttcaattagcaagggagtaactactcgctctagattggtgaatttttgtgagcattactcttttgtctcttctattgagcctttcagggtagaagaggccttgctagatccggattgggtgttggccatgcaggaagagctcaacagcttcaagcgcaatgatgtttggacactggtgcctcgtcccaagcaaaacgttgtgggaaccaagtgggtgttccgcaacaaacaggacaagcacggggtggtgacgaggaacaaggctcgacttgtggcaaaaggttatgcccaagtcgcagtttggactttgaggagactttcgctcctgtggctaggctagaatcaattcgtatcctgctagcatatgccgctcatcattctttcaggttgtaccaaatggatgtgaagagcgcttttctcaacggggtaccccgaccacgtgtgtaagctctctaaggcgctctatggacttaagcaagccccaagagcatggtatgaatgccttagagactttttaattactaatgctttcaaggttgggaaagccgatccaactcttttcactaagacttgcgatggtgatctttttgtgtgccaaatttatgtcgatgacataatatttggttctactaatcaaaagtcttgtgaagagttcagcagggtgatggtgcagaaatttgagatgtcgatgatgggcgagttgaactacttccttgggttccaagtgaagcaactcaaggatggaaccttcatctctcaaacgaagtacatgcaagacttgctaaagcggtttgggatgaaggacgccaagcccgcaaagacgccaatgggaactgacggacacactgacctcaacaaaggaggtaagtccattgatcaaaaggcataccggtcaatgataggttctttgctttatttatgtgctagtagaccggatattatgcttagcgtatgcatgtgtgctagatttcaatctgatccaagggagtgtcacttagtggccgtgaagcgaattcttagatatttagtcgctacgccttgcttcgggatctggtatccaaaggggtctaactttgacttgattggatattcagattccgactatgctggatgtaaggtcgataggaagagtacatcggggacgtgccaattcttaggaaggtccctggtgtcatggaattctaagaaacaaacttctgttgccctatccaccgctgaggccgagtacgttgccgcaggacagtgttgcgcgcaactactttggatgaggcaaaccctccgggactttggctacaatctgagcaaagtcccactcctatgtgataatgagagtgctatccgaatagcggaaaatcctgttgagcacagccgcacaaagcacattgacatccggcatcactttttgagagaccaccagcaaaagggagatatcgaagtgttccatgttagctcagagaatcagctagccgatatctttaccaagcctttagatgagcagaccttttgcaagttgcgtagtgagctaaatgtcttagattcgcggaacttggattgatttatagcatacatgtgtttttgcctttgatcatgttccttatgcattttgttgtttatttatggtgctcaagttgtacaagcactccccggactttacaagtccattttcaagtgatgcacaaatttacggggagatgagctacaacttgaccctttgagactaactgtgtgcttgagtttgcttaatttagtctcaaaggaggattgaaagggaaaaggtgaacttggaccatgcaagacttccactgcactccgatgaacgagtaacttcttccaagttcatcttagtactcttattgccttttactcttagttgaagtttgttttttgtgaggcaatggggttaaagggccaaaattgatcccgttttggtgattgatgccaaagggggagaaaataaggctaaagcaataaatggatcagctaccacttgagaaattttgaaaatagtagaatagagcttttggtttgtcaaaactcttttattgtctcttttgtcaaaagttggcctcttgtggggagaagtgttgagtttttgaaatccttgatcaatttcttttgggatacctctctttatgtctctacaagtgaatttgacatagagataggaaattgagtttgatttgcaaaaacaaaccaagtggtggcaaagagtgatccatatatgccaaatatgattcaaaacaaccttgagtcttcatttgcattgatattgcacttgttctaattgctttatgttgtgttggcattaatcaccaaaaagggggagattgaaagggaaatgtgcccttgggccatttctaagtgttttggtgatttagtgtccaacacaagtgcctaagtgtcaaatggtggacaaagtacaaaggtatgtttctcagacttagtacattgttttagagactaatgtattgtgtctaagtgctggaaacaggaaaagaacaattggaaatgtcttggctcgagcagccaagactctgctcagtctgggagcaccggactgtccggtggtgcaccggacagtgtccggtgcgccaggctggctcaggcgaactggccgctctcgggaaaaatttaacggcgtacggctataactcaccggactgtctggtgtgcaccggactgtccggtgagccaacggtcggccgggccaacggtcggctgcgcgatccgcgcgagacacgtgaccgagccaacggtcgggagggggcaccggactgtccggtgcgccaacggctccaaggctgccaacggtcggtttcgccaaataaggaaggaaatccgcaccagacagtgtccggtgcgccaggcgacagaaggcaagaattgccttcccggattgctctcaacggctcctagttgccttggggctataaaagggacccctaagcgcatgaaggagataaccaagcattccttgagcactcttgatcattcacacctcattcttgcgcacttgttcgacattctagtgatttgagctccgttctagtgtgctagtcttttgagcttaagtctgggtcttgtgtgtgcgtacttgctgtgatctttgtgtcttgtgtgagttgctaatcccttccttactccatgcttctttgtgaacatcaaagtgtaagggcgagaggctccaagttgtggagattcctcgcgaatgggattaagaaaagcaaagcaaaaacaccgtggtattcaagtgggtctttggaccgcttgagaggggttgattgcaaccctcgtccgttgggacgccacaacgtggagtaggcaagcgttggtcttggccgaaccacgggataaccaccgtgccatctctgtgattgatatctttgtggttattgtgttttgttgagactcctctctagccacttggcaattatcgtgctaacacttaaccaagtttttgtggcttaagtttcaagttttataggatcacctattcacccccctctaggtgctctcagtaccccctcatggccaccccaatggccacatttaatctccacttcccgcacaaaactcaaatgtagtgtatgaagctgagagcacctataggggtgaataggtaatcctgcaaaattagctctaaacaacacaaacttgtttttataaaatatgttagtgaaaactaaaatcaagttaggatgagaagagaggagaaaagataaattttcacttgattgctcctttaagacaagtattaaacttaggaacaatattacaagtgaatatgagaactcaagaagacaataatcgtaataagtaaaatggacaagatacacgtcgatttttaccatggttcgaccaatgcatactccacgttgtggtgacctcctttggtcaaaggttgcactcaacccatctcaagtgatctaaagaaactttatgccacagttgtcttccttatatcaatatctcgttgtgaggaatcttgtcacgtacatggttcgcattcggtttgtcttccaaaaccgggtgcgacaaatctccacaaattggagtccctcacgccttacacaaatgataacaatcaaattcgaagtaaggaggggagtagagacgcacacaagagcacaatgcaacaacaacacacacaaatgtgaagaagagagcgcaacaagaaaacgacagagtagcgactcaagaattgcgctaagatctttctagaacactttggaggcatggtcacgtagtactgaagttgtagtgtgctcaaagtacgcttgggtacttctccaaggcgcctaggggggtccttttatagccctatgggacctaggagccgttggagcttcatttggaagctcccaaccttccctatctgcaggtgcaccgtaccgtccggtggcgcactggacactgtacagtgcaacggtcaacagatccctgattagtcactttctgtttcagacaagcaccagactatctgatggaggtaccagactatcttgtgctccatctgacccttggctacgactgacgtggctgatagtcgttggctgtcttcacacgggactttccggtgggtggcaccggaccatccggtgaattttatccaatggggcctggttgagcccgagattcgctactttggccgtacgcacaccggactgtccggtgctacctagtccaacacaatttcttccttttgtgccaactttcttttgctcttgctgggctcgacttcatatggttcctagcacttagataaacatgattagtacctaaaacaattgactaagtactagaaacttacctttatcactttgatccatagaggtttgtagtatgtccattttcaagcccaaaaagtgtttttccctatattcctcaatatgctttacaaacatctgtgcccatgctcatatgaggagttgttagatcatagtattgtgttgagcatctaatcaccaaaataactagaaatagcccaagggcacatttccctttcagaagcctgagaagtttggaagcatgtgtcgaatcagctcatgatgggtcgcctttcgcacaactattgtctcgtgttttgtccccacttaaagactataaatcctacagtgggcttgtgggcattgtcagcaccccagtacgtgtaccccatgcgctacaataggtcagcacggaagggtaggcaatggaccctagcatcaaagagggtcatatctagaagacctaattacaaggattatgaatgcttggagaggaccccttccacgtggctaaattggaggctcccaccatgaacatcaagattccatcctacggacgccaccgacaggttgttagcaagaccacatatccctagcggttctgtcctggataggttctaacaatgtcacgtgtctaagggctcctacatgagctagaggccctctgggaggcctcctatctccaccctctacgttatgggggtctaggtgcaccacacatctcagacctagcgtcgctccacccgcggtaggtccgagcatgcaacgtgccccatggccctaggacgcccctagccaaaggggctccatacatgccacaaagcaccagttgtccccgccatatgtggtcaaggagttggtggagtcagagagttgttatgctatgtgatgggacaggcatgattgtgcccacaacatgcaccatgttgattgtcaaaccttgacatcctaggtatggcacaggtgcaccactatgggtgcatgcacgggcgacatgcaccatgactagtgatgactttgaccgtccacgatgtacatgtgacctcgatcgtccacgatgtacaaaaaatgttgctacagggcaaaagaatgacatatacgaaaaacttgactaggaggctaataccacctcatgatattacattaatagaaggttgcgacaacgatccgtgaaacccccgaaccgtatcctcccatcactaatagactgattcaagttgtccactctgcaagggcccatctaggcccaatggtggcacacagtcgagtcgtaactcaagagtgagaaaaagaatgacatatacaccttctacagtataatagacagggtcaaaccactaggctgaccccacatatcttgtaatctcatctcccctggtctataaaagggagagggagacccctttagcggagggactctctcttctcaccaacatacacacatttagccatttcaacatccaagcaatacaaaccagccactcccgagaggccgagaacgtagggtattacgcactagcgacctgaacctctttaaaacattgtctctcgtgtaccacactcgttcccacactttgccctctctcgttaacctggggatatccgaattaccattgagacctgtgggagaggaaatctccggccgggtggcgaagtgcacccgccctaaatcctaagatgaggagggggcctaagcgttttgcttgttagttggatgtagggatgaacacaagaacacacaagggtttagagtggttcgggccgccggagcgtaataccctactccactgtgtgttgtattgcttgagtctaagcctaaagattgagcttgagttgtgtcttaaatcacttgggtctatcttgtaacgtcgcatgcctccccttttatagctgaagggggcatgcacaaaggtactgagccctgacctatgggcccagggacataacagatataacacttggagctacaaatgttcgctgctggagcaatcttctcgcgccctgacatccgagatctgtgtatccttagcgtgcaggggaagcttctcgtataagggatggtgagcacagtgcgctacatggcacgagcgtactgtttgacaacagactggacaggcgcgccgtctgcaggatgaccctgacgccgtctgccagcagagtggacaggacacattaaatgctgagagggcacatcgtctgtcagcatggtggcaggccgcgcgtcctctccgcaataaatgcagagaccgcgcggctttagaggccttacgtcagggtctgcctgttggcttatgtcatgggccacaagccatgcgacagcaacgggtctccgcttgagaggggagcgtaagcacgcagggcaaggcctggacacgtgccagcaccggacccttactcatgctggggttccccctgtcccgggaccttgctgtggtccggaccttacttggagggacctggggccatccgagggacccaacatggcttcctgggagtctcggaccgtaactgagggtccgggttgtgcgtacaggggtccggtgttcctccgcggaggttcgagcctaatgatgcatcttggggtgcatcatcttttctcgccacgtggtgcccctagatctgcccatgtggtggggtcgggtgtcgttcaccgtgcggccaggagacgttgtatgtgtacagtgtctttatactgtagtagggggtacccctgattcagggtaccgacaagacccttgctaaacctaaaaggggttctctctataccccgaattgacacttgctatcacactcctatccaatgttatgtctggtgctactacagactcaccaactagcatttttaaattgcttttcaagttacatttccttttatattttttatgagttctcttgggtttacctatcactagttttcgcaagtatgcacaccacatctaactagaatcacctaagtcaaactacccatctcaagtctccctttatagtacaactaaagtaaaaaaataacgataatatcactaacctaagtgtctaataattttattgacacttagaactagttgttacttaactattttgagtatccatttaagaaccgaccgttggtatccatcaacaagggcatgaatgtcgcataagctcaatcatcgtgcaatattatgttctaacttatcttatttctgcaaaaatacacgttaatcataacaaaccatatgttgttattaatcactagaaccaaacttaggactagatatctttttaatatgttttttaatctaaagtaattggaagacctaaatattcctttttgttttcttatattttgagatctaaaactagatttttcgaatggttaagtatagattgtatcaatgtctaaggccgttcgatcattttaagttttggatttcaaaaaaaaaaatctaaaacagtagaacaaatgttcaggattctaagggctcgtttggattgatgcctaacttgctccactttgcctaatttttttgtctaaggttagttattcaattcgaacgactaaccttaggtaaagtggggcacagttagccacaaaccaaacgtgccttaaatgtgcttattcgtctatatatggtggttgctttggacttctcgatggtcctgaatctgaccctaaggaaggcctcgattcagcccactaggttcggcagagtttgaagccgaaggaagaaaacgcagtacatgtacaagacacagatggagatggacacactcacacacaggtcgtcgctcactccactcgctcgtatcgtctcgtgtcctatggatgcaatgcaagtgtatttccagaacacatggcttgcttgtactgggaggaattgggcgcgctgcagggcaggctgcagccagccgagattattgcgagttacgcacagtactctactgtttttaccagtgcaccgtacgcgagggtgtagacgaccaaaggtacggtgtctcccgtacgtgcagcaggatccccacgtttccgacgaagactttttctctctgatatatttgttgtacgtcgtgcagcctgcagggcgtttgaagacttgttggctggctcgcatcgcactcgcacccaatcaaaaagctagaggacgcttctgacgcagcgaaggcacatgcatccagcctcttcgtcgtgaaaaacgtaaaagatcagatagaaaagaaatcaggctagcagctctgaaagcgaccgtttcttttcccttccattttcttggtgacgaaacacgaccggttctctagcctcgtgcagtcgtggtgcatcgcggccggtttatttggagttgggcgtttgaccaccgagaagtggactgtggccaaaccagctgatcagaggccaccactgacatcgagcatcacgcataataataatgcattaattaatgcccacctgtgggaggctgggggctggccggctgggggatggtgctcggctgaagtgaggccggctccaatccatcgcagcagctagccgtccaaagtgactggcgtcttcgctttgcacctgcaccccgccgcagcggggcggcgagtgctcctgtatgaatctaacggtgctttggcccgcatcccctccacctccacctccacctccacctccacatccgtggtggatcctagttagttcggtcctctccctccatgcctcccgacgaaaaagcagcgtgtggtggcagtgacgaccacagcgaaaaaagcggcaattgaaggcgatggtgtagcctggagctggagtgggcgctcatgcatgcaaccgccgccaagtgctgctgccgcaaccgcaatagggcaacgatgtggtgtcgaggcggatacaggatataaaattcagttacagcgattaggcttgttttatcttatcttttagagtgcaccgtaaagaacaaataatattaatttagaaaacgaaacttagagaacgttgctgtagacagccttaatgtgaatcagtattttgtgcaaacaagtttataggcttagggaattggttcgcccttttctttacttactataagatgatgtttgaatgcactagagataatggttagtggataaaattagctagagacatccaaacactctagctaacagttcaaatattagctatttttagtaaatttgctactagttagctaactatttattagctagctaattctactagtatattttagctaaataactattagttctaatacattcaaacaccctctaaatcaccagtttcaacggttattctacgtcatcacttttacataaggccctcacatttctttgaaatcaacccaaaatcccaccgtcactcatgtgtcacgcgcggagcgtatatctatttttactctacgtctcgttttacaaccgtataagataagtcttatctcatcaccatgagtgtgcgcgaaagcccgtatatatgattttattcccacatctcgtctaataagataagtattgtcttttgcatacggaaccaataatgtaaccaccatgagcatttatattaactctcaacttctatctatatattattcgttttttatttttatgtaaccgttatgtactgatattttattaaatatttatgtgtccttgtaaacacgggtattgtatttagtgtacctaataaattcgctcgccgtggccacaaaatcacgacaacaataaaatacgtacacttggaggcgaagtcaccaacaaaacaagcgtctccctccaccggtccaccccccctctggctctctgcttctgcacctgcgtgtgctagcgcgagcgcgtgcgtcccttccccggcacgagcggcgcacaccgtcacatccgcgctccgttcgccttccagaaaatttaaaccccagcggagccggccacggccagtcagccgccacacggtctccgacgcgctgcccgctcgcctgccaaacccccaccccctcggcggcgatgctgacacgtcgccgtagcaaccacccgggctgctccttccccctcccgttcctcgtctgcggcctgctcctcgctgcggccgtcgcattttccccagctgcggccgccgaagcagctgacggcggcgctgggcacgagggccgcgcggggaaaccggaggtagaggccgaggcggaggcgcgcggggatggggttgccgtggcggaagccggcggcgaggtggtggctcagggcaatgccacggaggccaaggagggcagccttgccgacatgatcgaccgcgcgctggagaaggagttcccggagtccgagggcgagcagggcggtggaggtgcgtggatctggccaactccagggatgcatcgtcccgttcgggcgcgggatctggttctggggccggtggcgtgtgtcggtggccgtgctgtttagatctcggcctcggtggttggagcgtgtggggacgttgagaatggaggtcctatgtctgaacttggagttgcttgtgctaatctgagctctggttttgcagagaccgaccctggcagcttcaacaacacggtagctgagaagcaggtgagttcattgcgccattttgtttgtgtgctgcccctttgttggcagggttcatgattctgtgattcaacattgggtctgccacaactaggttttgggtgatttgcttaccaattccatgttggaatttgtgaatgaagggaaattcgcttttgaactggcctgtgcctgattcctacacttgcgaatctgctagtatgtagttatgttgccttgacccagattgtatttaggtcctgtttgtttaccctctagattatataatccagcttaaataagttgagagttaaacaaacaacacaggtggattatgtaatctagatacctagattataataatccataagcaggtcaatagatgcttatatagtccataagctgaattatataatcctagcattcaacgacccatccatatgtcatcatagtatagctattgggccaatgggccctttgactttatatggtcattttgctttatgttatttgttcggcattttcctagtgctgatgagggaaaccaatgtcttggctgttgtttattttgtgctatgcctggcaataataagtatgactatatgtttgtcgtgcacaattgcacatgagaggtgattagcatgggcatgactatttttattgtacccattagctactactgaagacaattataaattgtttgtcgtgttcctaagatgctacagaaaattctaatttggacatcctagttctgtttccctactggagttcatgtttgatctacatggttgctacatcgagtagttcatttcaaaggttcagcttcccattagtatgtttgttacttcgtcatttcttcataatactccttctggttataaaaacatattgtctgggacaagagttagtcaaaccttaaaactacaaacatcactaacttttaaattatttagatcgagaacatgaaagtgcacagaattgattgaaaatacttgcaaaatctcagaaatttgaaggattataagaatgtcattctaaaagaaattaatgataaaagatatgtgtcgagggctttgcaaactcagatgtgacaattatttttgtaccatagtgattatatattttaaatggaagcttataataacctgcatgatacaccttgggttcaagaaacaagatatcacaacttctattttctcagataatatagtggtctgtggtcctttatttggatattggaaaacttgaagcacatatatgtaatgcatcgttgtgtttacttgtactttgaaaatttggtgcttgcacatcacagatatgcaatgcaaactgctcatcttgttccttctactcgtaccagggagttcttgaaactgtagctagaagagtaacaaagaagaatgaaaccaaagataacaagtatgctgcaaatccagtcttcatagtttctgttagatgaaattaaccttagattcagaacgtgtaagagtttaaagttgtcattctgtttcatcaggtcatttccttttaaggaggttttcttggatcgaactgagcaagaggatgttcccacgttgatagatcggaaggtacaatcacatcctctggatggaattttctgtcaagtcactgtgcatgtgcccatacatgttggcataatgttgtggacatgttatgacttatgaccattttttataacagttttgtgttaatccaattttgaccccaggataatgtttttatcatctcaaacccaaagtcaaaataccctgtgctgcagctggaccttaggtatgttactcagtgttcagttatttgatgtatcggatgaaaaaaaatcttttttgcatggaaacttatctgttgaatgtatattattgtaggttgatatcagatcttgttgttgttatcgtatccgctacatgtggtggaattgcctttgcttgccttgggcaaccggtgagtacctgtacttttatttcctctaatttttttatcatcattaacagctggaaacataatttgtgtattcaaaatgttgtatttttaaggttaaggtacatgaacctacaattcaaagtatattgcaggtgattacaggttatctacttgcaggatctataattgggcctggaggttttagctttgtcaatgaaatggtgcaagtaaggtgcttccacctttgtgggttgctttttctaatgggttctctttatggcctgcatgtttgacatggatacacatgcccttgaaaacctctgtacaagagacctgccctgtagacttgtgtagaaacatatgtttcctggctaatgtctcctgccatcatatttctaacatgatgtgtgtgcgcgcacgatcagttcttttatatgtatttatatatttacagcatggcttagtttatttgtacctggataaatttggtctactgtttcattcattctaaaatcaactgtccttacaattatcttgcttatgcgtttcaagacctactgatttatgttattctgtgctgcctactatgcaatcacaatgtcgataagatgtacataagtagtccatgtttttaagtatggcattttcttatattgcatgctcagttctacatgtattttatatatactacagcatggcttagtttattttctacctgtataacttcactccactatttcatacattctaaaatcaactatccttacaattatcttgcttatgagttttgagacctactactgatttctgttattctgtgctgcctactatgcaatggaaatgtcgataagatgtatataagtagtccatgttttcaagtgtggcattttcttatattccactgtttcttttccaggttgaaacggtagcccagtttggtgtgatatttctcctgtttgcattgggacttgagttttctactgcaaaagtattttacctttaccatttcttccctcattcagttggcaacaccatctgtgatctgaagctaatatactgttgtttttacattgcctcagcttcgagttgttcgtgctgttgctgttctcggaggattgctccaaattatgttgttcatgtttctttgtggtattttggctaccgtgagtttcgtctctgttgtccgcattatgatatatactttggagctgtcttattacgttgtgtaaacctagttgtcactcttcttgaggggaacattgagatcttttattctatgtcctgacatcaaataatttaattgtttcataaaacattgatcagaataacaagatttgatgcatctgtaactcatttgaacatgcggccaatataagtgactagaagggattatgcagtagaagtaaccaagtcagcttcctggagcttgacctgccagtgttttgtgaaaaaatatttgatgcattttactaagccagaggggtgaaaacgattgccggtcggtcggaaatttacgcggtttcataattaatctacttactgacgactgacgttgatagatatttgaaattcaaaatttaaaaacggtaattttcggaaacgatacagttacgagacaccggttacaggaatttcagttacggttttcagccattgccagctattttatttgtttctaggttgtatggccttgtcttgattcataagagcatggttgacagatcttttatgctgtttaatgcagctatgtggaggcaaaactaaagaaggtgtttttgttggtgttcttctctccatgtcttcaacagctgtcgtaagtatctggtcagggtcaacaggtggccagtggcctatcagagaaatcaatatttttcagtgtcaataactcttgccattatgattatttggtccagtagcctggctctcttcctccctctctctgtcgctcacgcatttgcagacacacaaaatgtttggtgctgcattttgtgtttgaaattatctcgaagcaagtgaatgcatgaatacataattgtttgtgaatgactaacattctttgctgtgctgtagtgtggttctcacaattgcatgcaccttttgttgtacacaaactcattttagtttctgagaacaacctttttattatttgaaaatataaaaaatgccagtaggggcttcatctgctgctcatatatatgaaaaatatttgcctgtaccacaaatggagtcagtacatcttgattgagaaatttagcacctgatgtttgaaaccctgaatatagtatgcttggatgttttgtcacttgcaactgcaataagctcattatttatgtcattgtgtagtcattcgtgatgctgctggtgtgccacctggttatctgtttattcaaataatggtgagttttgtttatgaaggttttaaagtttctgatggaaagaaatagtatcaatgctcttcatggccaggttacagtcgggatacttatattgcaggtctgtctactttctttatcttttgtgtgcaagatgcatctgtgtacatgcatctagtgtctgccattgttaagaaaagttgatccaaggcacttttctttttccttttttataaattaagaaatatatctcagttgtgtgacatcctatttctcctgccccccaggattgtgctgttggcctgctgtttgcgcttcttccaattttgagtggtacatctggccttcttcacggagttgcatcaatgatgaagtcgtaagtgcagcatttctttcccccttttgccctgaagcctgaagtactttggtaacctttatattgcaaatttgttttacaatgagttgaatgttttgttggcttatccacttgatacaattcttgtacactaagttcatgttttcttgacatggtggcaagtccagttgatacaacattgctaaccccaaggcccaaagtcaccctaatagtttatgatctctttattatcttgtatttaatattactaattgtattatccattatattttgtttgctagcctataaaagtattctagtatatagtcagttgtgaaattaatttttgatacaaaacttctcaggctggtggtattgataacattcctgaccattctctctatcctctcccgtaccggcgttccttggtttcttaaactgatgataagtctgtcatcacaggtaaagtttgattttataagaaagcagtgcacctttttgagcaatttgagttttgatcttgtagaacattcttaccagcaatcttatgttctggttgctctgcatgtcacacagacaaatgaactatatcagctggcagcagttgcattctgcttgttatttgcttgggtgagtttctactgctcttatattggtatgttgtgaaaactgtgcagtaacatagaaaaggggtcttatttttgtacagcgcaagcgtttgcatgtgctaaaagcctaaaacctgctaaaagttatgttttaaacgaatcaataaaggggtattgcaaatgcttacttcatacataaaacatatataaaggaacacaatacttactttcctgaacttatctttaccaattgaacttttctagattttgatttagcttatggacctatatttctttactttatcatcaaaactgtatttgttaaagacttaaaggtatgcagatgagcagatcttaaaaattcttgtcattctcatgtttacatccttctatgatgcagtgtagtgataagttgggcctgagtctcgagttgggttcttttgcagctggagtaatgatatcaacaacagaccttgcacaacatactcttgaacaagtaactttttacatgtaccttgcatgttttttctgtcccctttccaggaaaaggggggaattactatctactaccccctctttcaaaccacaggccactttagctttgttctaagtcaaacatctttgactttggccaaatattaaaaatacatcaacaaatgcacaaggcacgtttcatggataatttaatgaaatcaatttgatgttggagcattttctgtaaaccttgtgaaagttagagaagtttgacttatgagattgctgaattgatctataatttggaacggagaaagtctttagtttgatctttattttatgcttgagcaaactcatagctagactcttgtagttagtaattcattatattgttctcttatttcaggcttgttctttctgcagatcgaacccatccgcaactttttcgctgctcttttccttgccagcattgggatgctaattaatgtccatttcttgtggaaccatgtggatatactccttgcagcagtaattttggtgatcaccgtaaagacctttattgttgctattgttgtaaaagggtttgggtatagcaacaaaacatctcttcttgtaagtcctttttcatatcttccttaatgcactcacatctgccagtgctcataaaatcacattaaccgtgtttgtccccacaggtcggcatgtcacttgcacaaataggagagtttgcttttgttctcttaagccgtgcttcaagtattcatctaatcgaggttattttcttgatattatcttccattttttgtgttatgccacacacaagagccatggttgtgctgacaatttaaaactatggggaccttgttattcttcagcataaagtacatgtaaatgcatagttttcagtgatgctgccttgttattcttgtaagcactgatatatcataatttaactttagatgtcaaagtttaacttcagcatgtctagcaaagcatgcaaatctttttgttaggagaggaaacctaaaccctaactagggttgggatgatttattaatagatagaaatgtatatggacgtggcctaagcccattacagttgagacacatatgtctaaaacctccgcagtcgcaactctaggcattacagatgttgagactggaccaaaactctgagaacactgtagagggatgccccttggtggagaataccatgttaggaggggaaaccctaactgggcctgggatgctctattaatagatagaaatgtatatgggctggacctaagcccattacagttgagacacccacttatatctaacacttttgatgctatcagtattaagtattaaatatatattatacttcccagtgtagtctgttggcactagttcccctttttagtcgcccaagaatccctagtactactattttcaagttaatgggtgacatctgataacttgtatttgattttttacagggcaagctatacctgcttcttcttggaaccactgcacttagtttggtatttgcctccattccttttaagctattcattttatctagataagcattgccattcaaaatttcagtgcgaacgagatcgattttttttatttgtaatgaatatttcattcaggagagtttttttatttgtatgtaaaatactactatgctaaagagtcaatttcatgcagtgaggcaagaggtctcagaaataacaatttcttgtcactttaggcaagaactttatacttcggacactggttttaatatgttttatgggggcgtttggtgtacagccagctgccactgcagccagcaccacaaatagtttgcagtcttgtccacgaatcatttccttatggagtgtttggtttgaccgtttgaggaatgggctagcgctagtctatcattttctcactcacttttttggtttggtttgtgtaatgtaatgagttgatccgttaccaccttattccttacagttagtactaatatgaggaatgaggttatgtcaccaaatttgaggaatgaactcatgatgtaccacctcattttggatggagtgattactcaaaccaaacacccccttagtgtttggttctgagccaaatggtgcagaaaagtgagtgacggaaaaacttgccttccgaattgataaatctatagatccaactattacaaaccgcatgatccaagcaacatgaatgaggtaaactgatccacaggggttcatcagtcatctcacttgtcccatgggttggggtcacaaaatgtctgagcaaccataaaagaaaactaagcagaagctaaggggcatcttgaaataatttcacatgtctaatcgacaatttgtgaatagcacccttcttagtggcgttgccgaaaaatcttgagactaatctcttgtcttgtcttttgtcatgccttcatcctggcttgctgttcatccgatgaccgagtttcatgaaattaatatggcaactgactcttgtgtgtacctttgcaggtgacaacccctctgctattcaaaatgatccctgcaatggtccacctcggggttcttttgagatggttttctgtcgataccaatcaggtggaggtacacgatcataccagttgagttcattgatggattgctttactctagaatgtttgccaatcaattcatcggttcttccttttcagctgggcctgaaaaatgatgtcctccgcatcgatagcggcaagcgcataaatctgatagtccaaggctcacatgactcatgacacatttgacacactgcaagctactttttgtatggcttaagtttacaagctctgtaaagtgttttcacctgtactgaagagtttctagcagatatacgagggtggaggcaagagaactcaactcagatcttgctcctagtgcaagatcaatcctcccccgtcatgacggctgcaagggcaaagtcgggttttgccgttcttgagagcagtgtgtcttggatgattggtgcagtgagtggctgtcgaccccaaatgagggtctcgtgtaacatatgaatgtatggtgattaattaattggattagcatgataggatgtaggcctgatcctcagtaaaggttatgcccttgtgttctttcaccaaagttgtgtatcctcactacacgaaagtgtgtacgacatccatcagatcacgaattttgttgtgtagccatatatgtcagtttcttaacatgtccaagttcatgagtttttttttcctcacgggaagcttttgagtaacctttgttcagatatcactttgttggatcgagtccaggatctcaatgatgggtgtgtttcaatgaatttgttcactttttattataccatgttgcatggtcgcctcgtatatggtgaattaccagctgcagtgcatgcgttctaggcgattcacgtgtgtatgtattaggaaattttaaatccgtatcctagttacatcattgttcagttttcttcagcatcattactcagttttgttcctttctagtttactacccatcagatttagctccggcagccccgtggccctccgcccccgcgccggcccaggggcaaacccgcccatagccaaaagttacatttttcagcttctgtcgtagcttctctcagctcgaattccgcagcttctgcgatgattgagcggccgggtggatggatattttggtaggagctgttttccagcttgtgaagccgacaacaatccctaccaaccaggctcttggtacacgacgcgacagccgacagggtcacaagaagttaccggctcagaacaagttcatcgagtctcgatgtctgttctttgaaagtcgttctccctccatcccaagacgtgagcctcattttgacctcttaagtcgtggcatacattgtacatattacatctaccacgacattatgcacacagcaccgcggacatatagacttcaatgtgtacagagttcacatgccacgagcactgcttatccgcgcttggtaaccgttgacgttgcatcgctggtaatgtacacgctgcatcccagcacggccgcctggaatagaagcattttcaggctgaccagctgctagctgatggtaaacaatggcaagtgaggggctactgctgcttcctgccgcgtcgctccagtctgcttctgatggtcgatgttgaagtacatgtctctgccgaactatctacttgcctgggcctgcctgttcatgacgtcatggtagtatagaaggacacacatcggctgtccgactatactgaagaaccaaaatatcatgttgcccacctgccaaataagaagatgatggttaggtagtggcaagaggtaatgggaaaaaaaggacataattgacacagcgtaccattacatgcttgaacgtagcatggagatatcttgtcaagaataccaacggtatctgtgagtcagacatcaaccagtgtcagcctatgtgaaaacagtggaaggtacattgtatccaagatgtagtattgttcttatggatgtaatgatggaatcaaaacgtaagagaatagacactgatggactcaaaagaaaaggcagggataattacaagtcgttctagttttcctagattcgtagctacgcatctagataatgtccagatatataactcttagcattatctataaaagccaagtcataatgacttacagttcgaaatggaggtagtagttattatattattactacttctatacctgaaaccatgatcctattttctagataggtaacatttggtatgcatctagatatacacaatgtctagatatataactattataatctagatatatacctagtataatgtaactagaaaagccaagccagaaagacttataattcggaatggaggtagtagttatatattagtgttatttctatacctgaaacatgatcccagaaaatgcccagaatttgaaaatgtggcacggcaccgcaatacatatctgtgaattcacaatgtaaaaagagatgtggtgatgatatattggtacgtaaggtcaaacgtattgttagtaatgtgctgagtggaattcgaacaatagcatgtcttaggaaaaacagaaattgaaccgatcatgaaaaaggcttctgaagaacttaaagtacctcatggaatacagctgaaaccagaaacgagattagaatagctacaccctgcagtgtagatacaatacgaatttgagaagtaggcagtgaaaatcatgtcagttctgcaaaaatgaaaggaccaacaaaattttatgtatgtccatgtattcacattgtctaatttacttttgccagtcagcagaaggcagcattttgttgccaagtctagatatcctttgtttttatttaaaatctttatccaagaacagtaaagtttcagccactataaaattcaagcatagtaaatctttatataagaagtaagaacttcatatcttaatttacattaccaaattgatttactatgcaaataatattgaccactagtgttctgattttctcacaacagtttcagccacttgttcagttgtattcattattattatgacaaattgacaattgagtgctaacactctgtccagctctgcttccccattttctaaagaacatcatttgtatattgtgaattctatattgcatcgatgttccaaactaaactgcatttggagaattcaaaagcaaagaacaaatgtagagttttgtacacatatagaagcaattaccctggaaaagcctttccttatacatggaaaatatatgtgtctgatgatccacttatgaacaggctgacaaaaaatagactaattgtcagttatttgaaagatattattagacaaatatctcaagctcagtgacagaagttaaggaagtcttaactaaatagaagagtaccactaccatcacaactgtccttagttaagtaacaaagtctcaactaaataaaagggtatagaatctgaatatagaagtaacaaaaagattaccatgttccacatcctccagtactgaggtaaagccccaaaataccatcacatttaagtacatgagaatataattgatgtcagtcctatttaaagttctcacttcaaaagaaacgaactcaattttaacaggcatctcacctcttcaacagttttggcattccaccagtccttatagaattcacggtcaccgaaacagaggagttcagctacaatgttcagcctgaaaccaaccaaaagagcaaacaagaatgccatggaaaatggaaatcaaagtcccatgcaggtcaaaacccaattaacctgttatataaaccaatcactgccgcacaaatttaaggtactgttgaactgaagcaagatactaaccataaatgaaaaaagcaatagaacatgcaaagccatacatataatgttggcactgagagttttaagactctttctatagcattcaaaaaattccctttcagtggatgtttggaattcttcacaattgggtttatatactgcaaaatagaagaaaaattggtaatttaatccaaagttatgtataaatacaagttacttaaggaatataggaggctcacttgctcaattatgaagcccatcaagcctgtaaaaaccacgcactttatgagttgctgggtcacccaaccctttctaatacatgtagtttgaggataagttggctgcataacatgccaaagtgacatcaggaaattcatgttgtcactggcataactagatagacgcgatgaagaaaagcagagtgtagacattaaaaacaaaaacggggcattggtccaataatagtacctggtaacaaagtgttggggccaacatgaagtacactagacttttaaaggttggatctttcatattctcaggatcgacataatttccatatgcagcaccctaaaaataagaatatagcaatagtggttatttgcatgaaaaatgaaaatgaagggatataatcatatgctaccgttgcctgaagttagaatgagggaaaccctaaccctaattagggttgggaatgcattgatataacagggttaggtggaccaaggcccattacaatagaggtatacactaacagttaagctaacacatgagagtatatatgatcagcccatgtaacaaaaacactgtatgagaagttaagaacaatttttttactctcttgatggtaacgtatattgattggcaccacatttcatcctatgcaaaaattgaaactagatataagacattcatgaaatgaaactggaaaagaagtttaaacaagtgggagatattctagcttcagaaaaatttggccaccaaaaggagttttaagaaaagtttgaacgtcaacaaatcaattttgagaaatgggcaacatgttaacaaaatatttgaactgattcagattaacatgtcaatgcattaccttctcagtacttttggacaatacccttatatcataatttgtatgtgcataagagacaagcttcatccacatgatgctcgcaagaaacattagcacaaatccagatagtacggttgagnnnnnnnnnnnnnnnnnnnnnnnnnnnnnnnnnnnnnnnnnnnnnnnnnncgtgtacgtctactagagataaatgaacatttgcaatagatttttatcaccagatacatttttttcttgaatatgctggagagttgcgtttctttgtattatagtgtggagtcaccagatacaattaaataaaagtgttatgtagctacctttttatccacccaatttgcatagtatagtacgtatcttgaagggaaagactaaatgtttggggcacaataatgtagttggccaccataccatgaagtacagcaaattacgaacaagattaattgaatgtattccataccatgaaatactagagctcaacgaatgtcaaaataagatgcatccaaacaaactgcaaagcagaaagaaatgcttacttaagagtcacaacaactggatagacaatggcagatgttgtaataatgatatggagtagaataaccacctgcaagaggtgtatagaagtcataaacgataaatggcacctggaagatgcagaatagaggactgtctagttttacatctaattcaatcctcaacacttatacctaagaaataacaaaagagaacttctctacaaaatactacgcaatcttgtgagtcaaacttacatgttcaccaatgagctttcttgtgatcagcttctcagccatgagtgcaactagtgggaaaactggtagagtgaggctgaaattgacagattgattactccacagttcttatttgaaacccatctgaattaaaaatgacaacaatttctaccagcacattagaaggggccagtcacccagcgatcttgcactaaaccaaaatccagctcttatcaacaggccatactgcaccagccaatttaaataaaacacagaatgtgtcagatttacactagacaaatgcgcaggaagaagaccagatgtatttcagaaggagatggattgagggatctgtaaatgaaggtgaggaaaatgaaaaaagaaagaaagtaataaaccttcattaaattctcaataatgagtctgctgttcactgcgatcagaacaacaatgcatagattcagaagaccagcatggctctgcaatcaggagaagtgcttagtttcaagacttcaattctccagagcaaccaataaatacggtttgcaaaaaataaggatgatctcagttgaagtacaagataaaatgatatatggaatactgatatattataatcaagttagcatggactcaattatcaaagcgttgtccactgtgtaatcccaggaaccatgtaggaggcatgtgatgtataaatattcatgcaactaacagaggattatttatcatccaaataagcactcctaccttcaaaacagatttagagtatgtgcagaaacaacaaagtctaataaaagtatcactagaaaattacgtctcacgtgtttctgctgtgatttgagccctattaagattacactgggaaaagggctccgagagtagcaaacaaaaataatgtcaatgacaataaaaattgtctaataatatacctattaaaaaatggagggctaaccagttaaaacttacaagtggtccaatacagttctatgtaggtgcacagttatatggtcctcaacaagaagcaatgccccaagcaggaaagccaaggtgtacaaacaatgtaacacgcattgtagttagaaaagtcagcattaataatactgggggcactgcaggtgctgtcccaacaactgtccacatcactatagtgagtaccgccaacaatgaattcaatgattcattcgctcatccagtcatccgtttcgacaagccaaagctcctccagtggtaacggttacgctcgttgtttgctgcttcagccggccgatgccaaattctgcgtggcatgcatctggcacccgcgcaccggcactggtccccctgatcccaaaacaagtaaacaccgacctcaatcgcagcagcatatgccccccacgaaacgaattgtgcccattcgagtacacgcgcacaatctatccacaattccgaagcccaaggcccacaataaaacatccgtgcgcgcgagatggcaaccggcagtgttaagctaccgatagcacaaagtgtgatttgaacacacacacacacacacacaccaaccaaaaaaaaacagaggcagagttgactggaagcaacaaacaatttgcaggattttgcaactggcgtggatcgaagcacaagcgcggggatcaaacaatcgcttacaaacagcgagcctaaaattcgcgtctcctcacctgccggaagatggcgtcagagctgagggggctctccttgacgcggcggtgggcgggcgccgacgcgcggtagtatagcatctcgtgctgctgctgctgctcctgcggcggcggattcgtcggcggttgcggctcgccgttctcccgcaagcctaccgaggaatcgccggcaaggtcgccggcgtcggctgagggggcgcggcggaggcgaagggaggacgagtcgcccgcgtcgcggccagggccggcgcgatcggaggcggcaggcatggaggggggcggggccatgcgaggaaggttccagaaggtgagggagcggggctttgggggtgcgatactttggggcagcggtggcggtggcgaccttggtgcctggtggggaggggaggagccgaggtgcgtgttttgatgcgggtgttgggctgcgcggcggctgacgcacaaaagcgcgggggcgagatggcggcctcgaaaaggggacacgtggacgggcgagcttgccaggcgtcctcaccgtcaccggcttggttggaagggtccggtcgggcgagtcgtcgcaggcagcagtcgggagcggggagcctgtctgtctcgtttgatcgatcgttccagccgcgttgaggctgaggatggcacgtccctcttgtggaacgtacctaaagatgggagaaaatcaaacttggccatggagatttgtgtgctccggaaaatccacacctgtaagcaccacctatatcattagtaaacgtgcctcgtacaaaatttaacatattttaaaatcaggattcctacaaacattcaacacgaattgttctaaaacttacatgagcgagagtgaaccgttgatcagggttatttatgtagaacatgtttggttgccatcattaaggagtgtttcggaacacatttttaaaaatatcacagtatacaaaatgtcatgacgtaatattattttttattatattaaagtatcaatttcgatagtcgttctgcgtcatattttaaaaaaacatcctcatatttctttataaactaacatgcggttctctttttcatctatccgtagtacgtacgcacacaacaggcttcgctcagccatgcggcatccctggtgtctcgtccattgggtttatcgtttcccaacgactgcacgaaccctccacgcacaacgcggggtctactccagactcatcgtgctctgacgccccacgatctcccaacagtagcgagaaacctccacgcacaacacggagtctatcgtgaacccaacgcacgcggaccgtccggtgaaatccagtctagcccaagtttggctcttttgagccaaaccccttcacttcttttttactctctttttaatgattcctattatttagacaaatatagttagcaacaaaaataattgactaagagctagaatcatacatttatcacttcatttcaaaatggtttgcaatatgctcaagctaagtccaaataatgccactttactttcacaaacaagttagtagtcaaacaaaggtacaagaaacaaaatatagtgtaagtgcaacttattcaaatacttaaaccttctgtttttatagttttacccaaggttacactttttgtcttccaatccaactcattttggacttcacatattcaattttcttgacttaaacctgtgctcatgctcatatgaacaatgttagttaaaagtggtgtgttgatcatttaatcaccaaaacaactagaaattgcccaaggcacatttccctttcaatctccctcttttggcgatttatgccaacacatctaaagcaactcaaagctactaacataactaaatatgagccaacttttgcaaattgaagtcaaatcaaacaacaattgaataagtataggatttgacatatgtggatcattttgccaccactcgttttgaattttgcaatcaaactcaattttctcacttttaagtcaaaaactcttttagttttgcaactcaaacaatttttagaaattagttttgatcaagtgtcaaaaactcccccttttccataataaagtcttctcccccataagagaatagttttgcaataagagagctcctctttgcaatcaaaaaggtcaggatagagtcgagtcggacttggcttactcttgttgtgaacgtcctagcttctcctccttgacatattggcctttcccaagttcttgctagccctctctaaggttcctaatcatcaaaagattcacgacaccaagcataagctctaaaacactattgactaggttagaactaacttggagatttagctgttgtgcacctgctcgtgttgccggtccatacattgtttgtatgggagtgaagtcctcatcaaactgggatcgccaccacctagaagaaactaggtccctctagggtggtctcaaggacttcgtcttcatccacattttcccttccgcggtggttgtcgaaggcatgcgccctttcgtcgggtgttaaggcggtgcctttgctccgtggcataggcccgctcaagggtgtctttgcttgctgaagatcccttgtctgttggtgccttcgctattagtgagccccctcttgcgcgggccttcatatagtcattgttagtggagaccatcgaagggaccttcgttggtgcgggtctggcgaagttctctaacgcgtggaacactgcacttaaacatgggttactttcggcctacgcagggctgatcaaggtcgggttcggccttcgctccaataatcaccgcactccaatcgccatcgagccatatagatgctgattgccaagagtaacaagcactagacttttacttggctaagataagcctaatgtgggtggtggatgcacacaaatctctctttaggcactaatgaggttgctaataacaagatccacaattctctaatctcctcacggtgctaagcgtcttcgtttctctcaaaaggttgctttagctattgaaaggggcaagacatcttaagaagcaatggacacatccggtgttactgcaaactgtgcaaggcatgctttatctattttttgtgtttccttccaaattttgtgtgggctatcttggattatcagtgaaagtatcctgggggggggggtgaataggcggaatctaaaatttacaaacttaagcacacactacaagccggggttagcgttagaattaaattcgagtccgaaagagagggaaaacaaatcaacaaggaaataaagcgaatgaacacgatgatttgttttaccgaggttcggttcttgcaaacctactccccgttgaggtggtcacaaagaccgggtctctttcaaccctttccctctctcaaacggtcacttagaccgagtgagcttctcttctcaatcaaccgggacactaagtctccacaaggaccaccacacaattggtgtctcttgccttgattacaattgagttggaaacaagaaagaaggaagaagaaaagcgatccaagcgcaagaactcaaatgaacacaaatgtcactctctctagtcactatttgattggaatgaactttggacttgggagaggatttgatctcttgttttgtgtcttggagtgaagtctagagctcttgtattgaatgcaatggctaaaaacttggatacattgaagtgtggtgaaggaccgttggtgagggcttctgtcgtatggcgcaccgaacagtccggtgcgccaccggacactgtcgagtgcgccagccacgtcaccaggccgttgggttccgaccattggagcttctgacaactgggccaccggacagtccggtggtacaccggacagtcactattcactgtctggtgcgccttctggcgctgctctgacttctacgcgcaggcgcgcactgttcactttcactgttcctttgcagacgaccgttggcgcgaagtagccgttgctctgctgacacaccggacagtccggtgaattatagcggagcggcctccccgaattcccgaaggtgaaagttcagtgtggaactccctggtgcaccgaacactgtccggtggcacatcggacagtccggtgcgccagaccagggctgcctttgggttgtcttttgctctttttatttgaaccctttattggccttttaattggtttgtgttgaacctttggcacctgtaaaacttatagtctagagcaaactagttagtttaattatttgtgttgggcaattcaaccaccaaaattcatataggaaaatgtttgaccctattttcctttcaatctccccctttttggtgattgatgccaacacaaactaaagcaaatataaaagtgcagaattgaactagtttgcataatgtaagtgcaaaggttacttggaattaaaccaatattcatttcataagatatgcatggatggttttcttcttatttaaaattttggaccaacgcttgcaccatttgttttgttttgcaaatgttttggaaattcttttcaaagtttttgcaaatagtcaaaggtatatgaataagattttgagaagcattttcaagatatgaaattttctccccctgtttcaaatgcttttcctttgactaaacaaaactccccctcaaagaaattctcctcttagtgttaaagagggttttagatattaattttgaagaggttataccaatttgaacttatataaaaaataagctaccaatttgaaaatcttaaaaaacatttctttaatacaaattgaaagactacaaatttttgaaattggtggtggtgcggtccttttgctttgggctaatgctttctccccctttggcatgaatcgccaaaaacggatacttgtgagtgaaatataagccctttttcaaactttctccccctttggtaaataatataggagtgaagattataccaaattggagagcgttgtggagcgacgacgaaggatgaataatttgatggagtggagtggaagccttttgtcttcgccgaggacttcatttccctttcaatctatgacttagcataatattcacttgaaaacacattagtcatagcacatgaaagagatatgatcaaaggtatataaatgagctatgtgtgcaaaatatcaatcaaaattcctagaatcaagaatatttagctcatgcctaagtttggtaaaagttttctcatctaatggcttggtaaagatatcggctaattgttctttagtgttaatatatgcaatctcgatatcccccctttgttggtgatccctcaaaaagtgataccgaatggctatgtgcttagtgcggctgtgttcaacgggattatccgccatgcggattgcactctcattatcacataggagaggaactttggttaatttgtaaccatagtccctaagggtttgcctcatccaaagcaattgcgtgcaacaatggcctgcgacaatatactcggcttcggcagtagaaagagctacaaaattttgtttcttagaagcccaagacaccagagatcttcccaagaactggcaagtccctgatgtgctctttctatcaatcttacaccctgcccaatcagcatctgaataaccaattaaatcaaaagtggatcccctggggtactgaaagtcgcctagagggggggggtgaatagggcgaaactgaaattctcaaaaataatcacaactacaagccgggttagcgttagaaatataagcgagtccgcgagagagggagcaaaacaaatcgcaagcaaatgaagagtgtgacacgcggatttgttttaccgaggttcggttcttgcaaacctactccccgttgaggaggccacaaaggccgagtctctttcaacccttccctctctcaatcggtccctcggaccgattgagcttctctttctcaaatcacttgggaatcaaacttcctgcaaggaccaccacacgattggtgtctcttgcctcaattacaagtgagtgtttgatcacaagaaagaatgtctaagaaaaggaagcgatccaagcgcaagagctcaaatgaacacaacaaatcactctctctagtcactagggctttgtgtggagttgggagaggatttgatctctttggtgtgtctagaattgaatgctagagctcttgtagtagttgggaagtggaaaacttggatgccatgaatggtggggtggttggggtatttatagccccaaccaccaaacttgaccgttggctgggctgtctgttcgatggcgcaccggacagtccggtgcacaccggacagtccggtgcctccgccacgtcaccagtgccgttggaaatcgaccattggagttctgacttctgggcccgccttgatgtccggtggcgcaccggacatgtactgtagagtgtccggtgcgccagcatgggcgtgcctgaccgctgcgcgcgctggcgagcaattaatgcgctgcaggtagccgttggcgcctgaagtagccgttgctccgcagatgcaccggacagtccggtgcacaccggacagtccggtgaattatagcggagcggctagagtgaaaacccgaggctggcgagttcctaaggccgcccttccttggagcaccggatagtccggtgaattatagcggagtggcctctggaaattcccgaaggtgacgaatttgaaacctgagtcctctggtgcaccggacatgtccggtggtgcaccggacactgtccggtggtgcaccggacagtccggtgtgctagaccagaggtgccttcggttgcccctttgctcttttgttgaacccaacgcttggtctttttattggctaagtgtgaacctttgacacctgtttaacttatacactagagcaaactagttagtccaaagatttgtgttgggcaattcaaccaccaaaattatttaggaactaggtgtgagcctaattccctttcaatctccccctttttggtgattgatgccaacacaaaccaaagcaaatatagaagtgcataattgaactagtttgcataatgtaagtgtaaaggttgcttggaaatgagccaatatacctacttacaagatatgcatggattgtttctttcttatttaacattttggaccacgcttgcaccacatgttttgtttttgcaaactcttttgtaaatccttttcaaagttcttttgcaaatggtcaaaggtaaatgaataggattttgcaaagcattttcaagttttgaaattttctccttgtttcaaatgcttttcctttgactaaacaaaactccccctaaaggagatcctcctcttagtgttcaagagagttttgatatttcatttttgaaatactactttctcccttttgaacacaataggataccaattgataaatacttttggaaaacactaagtttttgaaattggtggtggtgcggtccttttgctttgggctcatactctctccccctttggcatgaatcgccaaaaacggaaccattagagccctcgaagtgctatcttcccctttgatcataaataaatgagttaagattataccaaagacgaagtcttttgctttctcccccaaaggtgaagagtggcttggagcgacggcgaaggatgagttacggagtggaagcctttgtctttgccgaagactccaattccctttcaatatacctatgacttggtttgaaatagacttgaaaacacattagtcatagcatataaaagagatatgatcaaaagtatataaatgagctatgtgtgcaatctagcaaaagaagttgcgtgaatcaagaatattgagctcatgcctaagtttggtaaaagtttgttcatcaagaggcttggtaaagatattggctaattgatctttagtgttaatgtaagaaatctcgatatcccccttttgttggtgatccctaagaaaatgataccgaatggctatgtgtttagtgcgactatgctcgacgggattgtcggccatcttgattgcactctcattatcacatagaagaggaactttggttagtttgtaaccgtagtcccgcagggtttgcctcatccaaagcaattgcgcgcaacaatggcctgcggcaatgtattcggcttcggcggtagaaagagcgaccgaattttgcttctttgaagcccaagacaccaaggatcttcctaagaactggcaagtccctgatgtgctctttctattaatcttacaccctgcccaatcggcatccgaataaccaatcaaatcaaatgtggatccccgagggtaccaaagcccaaacttaggagtataagccaaatatctcaagattcgttttacggccgtaaggtgtgattccttagggtcggcttggaatcttgcacacatgcaaacggaaagcataatgtccggtcgagatgcacataaataaagcaatgaaccaatcatcgaccggtataccttttgatccacggacttacctcccgtgtcgaggtcgagatgcccattggttcccatgggtgtcttgatgggcttggcatccttcattccaaacttgcttaggatgtcttgagtgtacttcgtttggctaatgaaggtgccctcctggagttgctttacttggaatcctaagaaatacttcaactcccccatcatagacatctcgaatttttgtgtcataatcctactaaactcttcacatgtagactcgttagtagacccaaatataatatcatcaacataaatttggcatacaaacaagtcattttcaagagttttagtaaagagtgtaggatcggcttttccgactttgaagccattagcaatgagaaagtctctaaggcattcataccatgctcttggggcttgcttcagcccataaagcgccttagagagcttatagacatggttaggatactcactgtcttcaaagccgggaggttgctcaacatagacctcttccttgattggtccattgaggaaggcacttttcacgtccatttgataaagcttaaagccatggtaagtagcataggctaataatatgcgaattgactcaagcctagctacgggtgcataggtttcaccgaaatccaaaccttcgacttgggagtatcccttggccacaagtcgtgctttgttccttgtcaccacaccatgctcgtcttgcttgttgcggaagacccatttggttcctacaacattttggttaggacgtggaaccaaatgccatacctcatttctagtgaagttgttgagctcttcttgcattgccaccacccaatccgaatcttgtagtgcttcctctaccctgtgtggctcaatagaggaaacaaacgagtaatgttcacaaaaatgtgcaatacgagatctagtagttacccccttatgaatgtcgccgaggatggtgtcaacggggtgatctcgttggattgcttggtggactcttgggtgtggcggccctttgctcttcatcctccttgtcttgatcatttgcatctcccccttgatcattgccgtcatcttgaggtggctcatttgcttgatcttctacttcatcaacttgagcttcatcctcattttgagtcggtggagatgctagcgtggaggaggatggttgatcttgtgcatgtggaggctcttcggattccttaggacacacatccccaatggacatgttccttagcgctatgcatggagcctgttcttcacctatctcatcaagatcaacttgctctacttgagagccgttagtctcatcaaacacaacgtcacaagagacttcaactagtccagtggacttgttaaagactctatatgcccttgtgtttgagtcataaccaagtaaaaagccttctacagtcttaggagcaaatttagattttctacctcttttaacaagaataaaacatttgctaccaaagactctaaaataagaaatattgggctttttaccggttaggagttcatatgatgttttcttgaggatttggtgaagatataaccggttgatggcgtagcaagcggtgttaaccgcctcggcccaaaaccgatccgaagtcttgtactcatcaagcatggtccttgccatgtccaatagagtttgattcttcctctccactacaccattttgttgaggggtgtagggagaggagaactcatgcttgatgccctcctcctcaaggaagccttcaatttgagagttcttgaactccgtcccgttgtcgcttctaattttcttgatccttaagccgaactcattttgagcccgtctcaagaatccctttaaggtctcttgggtatgagatttttcctgcaaaaagaacacccaagtgaagcgagaataatcatccacaataactagacagtacttactcccgccgatgcttatgtaagcaatcgggccgaatagatccatgtggagtagctcaagcgtcctgtcggtcgtcatgatgttcttgtgtggatgttgggttccaacttgcttcccggcttgacatgcgctacaaatcctgtctttctcaaaatgaacatttgttaatcctaaaacgtgttctccctttagaagcttatgaagattcttcatcccaacatgggctagtcggcggtgccagagccaacccatgttagtcttagcaattaagcaagtgtcgagttcagctctatcaaaatctactaagtatagctgaccctctaacactcccttaaatgctattgaatcatcacttcttctaaagacagtgacacctacatcagtgaatagacagttgtagcccatttgacataattgagatacggaaagcaaattgtaatctaaagaatctacaagaaaagcattggaaatagtatggtcaggtgatatagcaattttacccagtcctttgaccaaaccttgatttccatccccgaatgtgatagctcgttggggatcttggtttttctcatatgaggagaacatcttcttctcccctgtcatgtggtttgtgcacccgctgtcgagtatccaacttgagcccccggatgcataaacctacaaaacaattttagttcttgactttaggtacccaaacggttttgggtcctttggcattagacacaagaactttgggtacccaaacacaagtcttggaacccttgtgtttgcccccaacaaacttggcaactaccttgccggatttgttagtaagcacataagaagcatcaaaagttttaaatgaaatggcatgatcatttgatgcattgggagttttctttctaggcaacttggcacgggttggttgcctagagctagatgtctcacccttatacataaaagcatggttagggccagagtgagacttcctagaatgagttctcctgattttgctctcaggatagccggcagggtacaaaatgtagccctcgttatcctgaggcatgggagccttgcccttaacaaagttagacaagttcttaggaggggcattaagtttgtcattgtttcccttttggaagccaatgccatccttaatgccagggcgtctcccattataaagcatgctacgagcaaatttaaatttctcattttctaagttgtgctcggcaattttagcatctagtttagctatatgatcattttgttgcttaattaaaatcatgtgatcatgaatagcatcaacattaatatctctacatctagtacaaatagtgacatgctcaatggtagatgtagagggtttgcaagaattaagttcaacaatcttagcatgtcgtatatcattcttatctctaagatcggaaattgtaactttgcaaacatcaaaatctttagccttagcaatcaaattatcattttctactctaagactagcaagagaatcattcaattccttaatcttagcaagcaaatcatcattatcatttctaagatcgggagctgaatcaatacaaacatgagaatcaaccttagcaattattctagcattttcatttctaaggttgttaatagtctcatggcaagtgcttagctcactagacaatttttcacatttttctacctctagagcataagcatttttaaccttaacatgtttcttattttccttgattaggaagtcctcttgggagtccaagagatcatccttttcgtggatggcactaattagctcatttaatttttctttttgttccatgttaaggttggcaaaaaggatacgcaaattatcttcctcaccactagcattatcatcactagacgattcatatttagtggaggagttggatttaaccttcttccttttgccgtcttttgccatgaggcacttgtggccgacgttggggaagaggagtcctttagtgacggcgatgttggcggcgtcctcgtcggaggaggagtcgctagagctttcgtcggagtcccactcccgacaaacatgggcatcgccgcccttcttcttgtagtacctcttcttctcctttcttctccccttcttgtcgtcgcccctgtcactatcacttgataatggacatttagcaataaagtgaccgggcttaccacacttgtagcaaaccttcttggagcgggacttgtagtctttccctctcctttgcttgaggatttggcggaagctcttgatgacgagcgccatttcctcattgtcgagcttggaggcgtctataggttgtcgacttggtgtagtctcctccttcttttcttccgtcgccttgaatgcgacgggttgagcttcggatgtggatggatcatcaagctcgttgatcttccttgagccttcgatcatgcactcaaaacttacaaaattcccgataacttcctcgggggtcattttagtatatctaggattaccacgaattaattgaacttgagtggggttaaggaaaatgagagatcttagaatcaccttaaccatttcgtggtcgtcccactttgtgctcccgaggttgcgcacttgattcaccaaagtcttgagccggttgtacatgtgttgtggctcttcccctttgcgaagtcggaaccgaccgagctccccctcgatcgtttcccgcttggtgattttggtgagctcatctccttcgtgcgcggttttgagcacatcccaaacttccttggcgcttgttggggacttgttctcaaatgctaagagttaagaacaaggcaacataaaaagtgttaagtgttaaagtccttcgtccttcgaagcattatgtcccttcgggaaataatgagtttcggacgaaggtcataagagacataccttcgtaaacataacaagtaatgacgaaggactcatataaagcatgaaatataatataagcatcatcatagaatcatttctattttattaacatggaaaaatagaaatgatttcaaattacaaatgtaccttcggtcctgagagaaggtaaaaagtacaagcgtgacgcaaaagcaaatgccaagtccgcgtgaacagttcgggagtactgttcatctatttatagacgcgggacgcagcccacgtaaaattacatttatgtccattacatttgtcaatgacttatggaaatctgacaaggtccacatagtcttttcatctttaagtcggtttgcaacgccgaagctctataaaaaggaaccttcggccatttcctggggacgatttcagccgaagctgcttcttcacgcaagaccttcggcgcaacgaagcatggccccaacagtagcccctttcgcggcgctagatcgtttttcgtaacgagcttgaaccgtgaaaaaatcctctcaagcttcgggaagccgaaggtccgaaaaacaccttccctgagctcgttgccgagaaacgattcatttcccgagatcgtgtcggtcccaccttgcagagtcactgtttggtctttgcggtccactgcgcagcgagtacaagttactgcccgcctggtgtaaaaaccctgccgcttcgccttcttacctgcagcactatataaacagacgagtaggtgtgaagttaccacagcatttactgctatttgcactgttttactgccaaaatttttaaccatcaccgaagcttgtttgtcagttttgaacgaagctccatcttgaagcttgcttcggagaaaaaagtattaaagtttcacaagttcataattaaatggccagagttcgttctacagctagggttgagcgtgagggggacgaaactgaagcttcggagactatgcccatctccgaagcgatgcagcgctccggactggtgactacggaagaaatagctgctgccggagcaaacccgacagctgccgaaggagaagggaacattgaagaaaccgactccgaagatgactaccgtattgccatgcccagcaaacccagccacctagacttcggaaaatcgactgtttcaaaggttgatctcgccaagatggtaaaagcaggttttttcagtgaagatcagaagaagctacttcgcttcgggggagaagagaccaccccgaagccagagaaggacgaggttgtcatcttcaaaagctttttaaaggctgggctaagattccctgttcacgagattgttgcggagatattgaagaggtttggcatctaccttcaccagttaactcctaacgctatcgttaggcttagcgtttatatttgggccctccgaagccaagcagtggagccttttgctgacagtttctgtcgagttcatgaattgcattatcaaacaaaggccagaaaagatgggcttcatgaaaacttcggttgctacaattttgcctaccggaaaaccgcaaagtttcctgtaattagctaccgaagcaaatggccggcaggctggaaatcagaatggttctatgtcaaggtcgatgaggacaaggagaagcttgtgcaaagtccactcgagctaactttcggagaaacccgaccccactgcaacatgacaccagagggtcaaactcaacgggcaatggatgaattcagaatcattgcagagcatattggtaccagggatctggttcaagaattcttagcattcaaagtcttccctactctgaaaaaatgggaaatgccaaagttaaagggggagaagaaggaaggggatcttgtccggcttccttaccacttcaaattcaagaaatattttaagaagccctgccaagagtggctggacacagttgaggtgatgtgtaatgaaattcttggaaattattcgaaaaaagaagatcaactgatgacagcagccttcggtacccgtccgaagcgaaggctgaaccgagtgctcgatgcactgggcttcgaatatcctgactatgcgcagctgaacaaggatgctgagggccagagaagaaaaagagaggccgaagctttaaacaaggatgaagaacaaccaccaaaaaagaagaaaattgtcaagagaaagatatcaactccaaagcgaaaactatccgaaggagaggggacccccacaccaccttctaccagcgacgtggaggaaattctaaaggtaatgactgaacccatgcccacgaagctaagtccattagggcctcgactgacgaagctttttcaaaaggtggcggagccggaaaaaacgaagataaccaaagcaaaaaggcaaagaattattgccgtaacagaagttattgacaagacgccaccgagagcatcaattcagaaaacagcagctgctgaagacacaacaaacgtcgaagtcgcaccttcggaggtcgcggctaccgaagccgctacagccgaagatgtgaacttagagactaccattgagaatatcgacaaaattttagaagacatggctgcagaagaagctgccgctgctgctaaaaaagtcatggccgcagtgcctgagaaggggaaagaaatagccgaagtcgcttcggacgacgaagcctactcatttcaaaatttaattgggcaaaaactttcggaggacgaaatagaagagctaaaggactatgccaaatcttgcggatacaggccaggagctcttctattcggaggtgtggacgatgaaaaattaggctgcattcgagaccaaaccggagctaaggtcatcggtactctgtcaaagagtatcggttttccgaagctagagacagatatcagccgctaccgacgacagcatatcgtcggcagcttattttattccaatttcaaggtaaacaatcttttctctgttccttattgctttggataatgaaaatgttactaacgaaaactgtttttgtgcagagcatgctactgagcaaggctctgaagatgcagcaggatttagaggacaaaaaacacgaagctataattggaaatttagagagcaaaataaaagaacaatcagtcatcattgaaaagaaagacttcgaacttcaatcaaccgaaggcttgctggccgagaccgaagctaaaatatcagaattgaattcgaagcttatcggtcaatcaaaacagtttgaacaagaaaagctagagcttaattctaaacttgaagccgaagtccaagccaactcaaatttgaagaaatcattaacaagccttcaggataaatgtttgaattttagcaacaattgtatccaacaactaaagaagatcttttactcagttggagccagcagcgggaaatttaccccttcggatgaagatttaccaaaagccttcgatcatatcgaagctgaaattgaagaacttgacgaagttatagctgggcacggtgacttctgtgcctgggtagcttctcggggtactgctgcagcattcctgaaggctggctgcgagcatggaaagatcgtcaacaggcccaacttcaccctgtctccatcaatcctggacgatatacctgacctcgcccgaagtatctcaaatagatttttaaaaatgatatggacaaaaggcgggcgggagaaggctggagacgaagctcgaagtcatcttgaaccagtaagaaatcctactttgtacttaccttctccttcatacttgatttttactctggatacctggattcatgtaggatgacgaagctgaaggtgattaaagaatatgccgccgaagcgggagcctgaagaagattagtagtagtaggctagaaaatttgtaacaacttgttgtaaatacaattaaaccgttctcaaggaactttgtacataccttgtaatatatccttacccttttattaagacgctttgatgtggacgaaatcaatattttgagccgaaggcgaaaaacaccttcccttcttttcgtacacaacgaagcattaaagactgcttcttctttctgcggaagctttgcttttttgtacaaaacataaaagactacttcttctttctgccgaagctttgcttttttgtacaaaacataaaagactacttcttctttctgccgaagctttgcttttttgtacaaaacataaaagactacttcttctttctgccgaagctttgctttttttgtacaaaacataaaagactacttcttctttctgccgaagctttgcttttttgtacaaaacataaaagactacttcttctttctgccgaagctttttcttttttgtacataacggaacataaaagaccgcttcttcctcttgccgaagctttttcttttttgtacataacggaacataaaagaccgcttcttcctcttgccgaagctttttcttttttgtacataacggaacataaaagaccacttcttccttttgccgaagcaaccacttaggaacacaaatgctatgaatgaatgcttatgaatgcaaatgctatgatgtaatgtgcgaatgaatgtccaaagcatataaccgaagccacactcaaccattatttccttggaatcaaccacacatcagctctgcattcccttaggaacgactttggagcttcctcgtcttttacttagacggtataaactctgcattcccttaggaacgtctttggagtttcttcgccttttacttaggcggtataagctctgcattcccttaggaacgtctttggagcttcttcgtcttttacttagacggtataaactctgcattcccttaggaacgtctttggagtttcttcgccttttacttaggcggtataagctctgcatccccttagggacgtctttggagcttcttctctttcttctttttcagttcctgcactcgatggtgcgttctcagctgttacatttacattttttgggggattttgctcttataagactaaaaaaggaaattacacatgatggccccattaaaaacctttctcccccttcggaaaggaaaagggtgccatgaaaaagaaaagaaaaaacataaaaaattacatcatgttatacatagtatcgccgaagctcatccgcattccaagaccttggaatttcgttgccatccatgtcctttaatctgtacgatccaggccttgacgaagatactactaagaatggtccttcccatttcaactgtagcttacccactgtatctgggttagccactctccgaagcaccaagtgtcccggctcaatattttttaaccggacttttctatctcgccatttaactgtttcagcctgatatttattgatattctccacggcctgaagcctgatcccttctaaagcatccttttccacaaggcaagcatcttcgggacctgattctgccgaagctactactcttattgatccagctttggcttcttccggggttattgcttcgtctccgaataataacttgaatggggtaaagcctgtgaagaaaatgggttttcctcgtgggaaacaacgaaattattacatgaaaactaacaatgttctttgtttcacagaaaataaaactgaatagaaaagactgctatcaaaggtaggatatgtgtcaataaatgtgcttcgactctggcacagtgctgttgactgtgcgagcttcggattgttctctgaagtccctttggtgtggggcatattgactcccttctggctgttgaccctgttgcagtggaggtggaggcggaggctgctgccaggaagcttgaggttgacttgccgaagctatagaagctgcagggtggttgtctatgtattgtgggatgtaaggtggatgatacgaagcagtatgcatgacctgcttcggctgagcttgttgagatgcagcttcggctatttccttttgcttctggattgtaatatggcacgtcctggtggtatggcccttgctttctccacagaacaagcaaaacagtttccttggttgatctccgaatcttccggcgaagcccctggcgcctctgccttttggagctggtggccggaagaaagtttgttgttgccccgaagcctgtgaggagcactgcggtctgttctgctgactccccttatcatcattctgagtagagttgtggatggacctgacatgcctcggataggatcttcctccgaagcccctggtcatttcagaaaatctgaaggcctcctcccttctttggcgaaagtcattgtcagcacgaatgtactcgtccatcttttggagcagcttctccagggtctgaggaggcttcctagcaaagtattgagctggttggggtccagcggttgcagtgctgcagccccagtcgctgaagctttcttcagcgccatagcgagggtctatagcttccgaaggtgttcaaaaaactcgaagtggaagtgagttcacccacggtgggcgccaatgttggggacttgttctcaaatgctaagagttaagaacaaggcaacataaaaagtgttaagtgttaaagtccttcgtccttcgaagcattatgtcccttcgggaaataatgagtttcggacgaaggtcataagagacataccttcgtaaacataacaagtaatgacgaaggactcatataaagcatgaaatataatataagcatcatcatagaatcatttctattttattaacatggaaaaatagaaatgatttcaaattacaaatgtaccttcggtcctgagagaaggtaaaaagtacaagcgtgacgcaaaagcaaatgccaagtccgcgtgaacagttcgggagtactgttcatctatttatagacgcgggacgcagcccacgtaaaattacatttatgtccattacatttgtcaatgacttatggaaatctgacaaggtccacgtagtcttttcatctttaagtcggtttgcaacgccgaagctctataaaaaggaaccttcggccatttcctggggacgatttcagccgaagctgcttcttcacgcaagaccttcggcgcaacgaagcatggccccaacagcgctcttcaacccttgaactttgttatactcctctctacttaaagaggcgaggagtattgttgtcgcttgagagttgaagtgctcgatttgggccacctcatcctcatcatagtctttatcccctacggatggtacctgtgcaccaaactcaacaacatcccatatacttttgtggagtgaggttagatgaaatcgcattaaatcactccacctagcataatcttcaccatcaaaagttggtggtttgcctaatgggacggaaagtaaaggtgcattttttgaaatgcgagggtaatgtagggggatcttactaaacttcttacgctcttggcgtttagaagttacggagagcgcatcggagtcggaggtcgatgttgatgaagtgtcggtctcgtagtagaccactttcctcatccttttgtgcttgtcccctttccgatgtggcttgtgggaggaagatctctccttcttctctttgtggtgcgaagaagatttcttctccttccctttgttgaaggagctcttcttcttctccttcctcttggtgcgggactcttccgatgaagtgctcccgtggcttgtagtgggcttttcgccggtctccatctccttcttggcgtgatctcccgacatcacttcgagcggttaggctctaatgaagcaccgggctctaataccaattgaaagtcgcctagagggggggggggtgaatagggcgaaactgaaattctcaaaaataatcacaactacaagccgggttagcgttagaaatataagcgagtccgcgagagagggagcaaaaaaatcgcaagcaaatgaagagtgtgacacgcggatttgttttaccgaggttcggttcttgcaaacctactccccgttgaggaggccacaaaggccgggtctctttcaacccttccctctctcaatcggtccctcggaccgattgagcttctctttctcaaatcacttgggaatcaaacttcccgcaaggaccaccacacgattggtgtctcttgcctcaattacaagtgagtgtttgatcacaagaaagaatgtctaagaaaaggaagcgatccaagcgcaagagctcaaatgaacacaacaaatcactctctctagtcactagggctttgtgtggagttgggagaggatttgatctctttggtgtgtctagaattgaatgctagagctcttgtagtagttgggaagtggaaaacttggatgccatgaatggtggggtggttggggtatttatagccccaaccaccaaacttgaccgttggctgggctgtctgttcgatggcgcaccggacagtccggtgcacaccggacagtccggtgcctccgccacgtcaccagtgccgttggaaatcgaccgttggagttctgacttctgggcccgccttgatgtccggtggcgcaccggacatgtactgtagagtgtccggtgcgccagcatgggcgtgcctgaccgctgcgcgtgctggcgagcaattaatgcgctgcaggtagccgttggcgcctgaagtagccgttgctccgcagatgcaccggacagtccggtgcacaccggacagtccggtgaattatagcggagcggctggagtgaaaacccgagactggcgagttcctaaggccgcccttccttggagcaccggacagtccggtgcacaccggacagtccggtgaattatagcggagtggcctctggaaattcccgaaggtgacgaatttgaaacctgagtcctctggtgcaccggacatgtccggtggtgcaccggacactgtccggtggcacaccggacagtccggtgtgccagaccagaggtgccttcggttgcccctttgctcttttgttgaacccaacgcttggtctttttattggctaagtgtgaacctttgacacctgtttaacttatacactagagcaaactagttagtccaaagatttgtgttgggcaattcaaccaccaaaattatttaggaactaggtgtgagcctaattccctttctggtaccaaaggccaaacttaggagtataaactaaatatctcaagattcgtttcacggccctaaggtgaacttccttaggatcggcttggaatcttgcacacatgcatacggaaagcataatatccggtcgtgaagcacataaatagagtaaagaacctatcatcgaccggtataccttttgatctacggatttacctcccgtgtcgaggtcgagatgcccattggttcctatgggtgtcttgacgggcttggcatccttcatcccaaacttggtaagaatatcttgaatgtacttcgtttggctaatgaaggtgccctcttggagttgcttgacttgaaaacctaggaaatacttcaactcccccatcattgacatctcgaatttttgaatcatgatcctactaaactcttcacaagtagatttattagtagaccaaaatatgatatcatcaacataaatttggcatacaaacaaatcatttgtaattgttttagtaaagagagtaggatcggcttttccgactttgaagccattagcgataagaaaatctcttagtcattcataccatgctcttggggcttgcttgagcccataaagcgccttagagagtttatagatatggttaggatactcactatcttcaaagccggggggttgctcaacatagacctcctccttgattggtccattgaggaaggcactcttcacgtccatttgataaagcttgaagccatggtaagtagcataggcaagtaaaatacgaattgactcaagcctagctacgggtgcataggtttcaccgaaatctaaaccttcgacatgtgaatatcccttggccacaagtcgggctttgttccttgtcaccacaccatgctcatcttgcttgttgcggaagacccacttggttcctacaacattttggttaggacgtggaactaaatgtcatacctcattcctcgtgaagttgttgagctcctcttgcattgccaacacccaatccgaatcccttaatgcgtcttctaccctatatggcttaatagaagacacaaaggagtaatgttcacaaaaatgagcaacacgagatcgagtggttacccccttatgaatatcgctgaggatggagttcacggggtgatctctttgtattgcttggtgtactcttgggtgtggcggtcttggatcatcctccgtgtcttgatcattagcatctcccccttgatcattgtcctcctcttgaggtggctcctcttgatcttcattttcatcatcttgagcttgatcctcatcttgagttggtggagatgcttgcatggaggaagatgattgatcttgtgcttgtaaatgctcttcggattccttaggacacacatccccaatggacatgttccttagcgcgacgcacggagcctcttcatcatctagctcatcaagatcaacttgctctacttgagagtcgttagtctcatcaaacacaatgtcacaagaaacttcaactagtccagtggacttgttaaagactctatatgcccttgtgtttgaatcatatcctagtaaaaagccttctacaaccttaggagcaaatttagattttctacctcttttaacaagaataaagcatttgctaccaaagactctaaaatatgaaacatttggctttttaccggttaggagttcatatgatgtctttttgaggattcgatgtagatataatcggttgatggcgtagcaagcggtgttgaccgcctcggcccaaaaccgatccgaagtcttgtactcatcaagcatggtcctcgccatgtccaatagagttctattcttcctctccactacaccattttgttgtggtgtgtagggagaagagaactcatgcttgatgccctcctcaagaaagccttcaatttgtgaattcttgaactccgttccattgtcgcttcttattttcttgatcctcaagccgaactcattttgagtccgtctcaagaatcgtttcaaagtctcttgggtttgtgatttttcctgcaaaaagaatatccaagtgaagcgagaataatcatccacaataactagacagtacttactcccgtcgatgcttacgtaagctatcgggcggaataggtccatgtggagtagctcaagcggtctatcagttgtcatgatgttcttgtgtggatgatgaacaccaacttgcttccttgcttgacatgcgctacaaaccctgtctttctcaaaatgaacattggttagtaccaaaatgtgctctccatttagaagcttgtgaagattcttcatcccaacatgggctagtctgcagnnnnnnnnnnnnnnnnnnnnnnnnnnnnnnnnnnnnnnnnnnnnnnnnnnctcatggtaaaaagacaattgtagcccattttacataattgagaaacagaaaacaagttgtaatctaaagaatctacaagaaaaacattggaaatagagtggtcaggagatatagcaattttaccaagtcctttgaccaagccttgatttccatccccgaatgtaatagctcgttgggggtcttggttttttttcataggaggagaacatccttttctccctagtcatgtggtttgtgcacccgctatcaatgatccaacttgagcccccagatgcataaatctacaaaacaagtttaggccttgttcttaggtacccaaacggtcttgggtcctttgacattagaaacaagcaccttgggtacccaaacaaaagtctttgagcccttgtgtttggccccaacatatttggcaactactttgcctgatttattagtgagcacataggaagcatcaaaagtcttaaatgagatgttatgttcatttgatgcaataggagatttctttttatgcaatttaacatgggttgattgcctagagctagatgcctcactcttatacataaaagcatgatgagagccagagtgaaacttcctagaatgaattcacctaattttatcctcaggataaccaacaggatataaaatatagccgtcgttatcctgatgcatgggagccttgcccttaacaaaattagacaatcttttaggagggcattaagcttgacattgtctccctgttggaagccaatgtcatccttaatgccagggcgtctctcactataaagcatactacgagcaaatttaaatttttcattctctaattcatgctcggtaattttagcatttaattttgctatatgatcatttgttgtttaatcatagcaaggtgatcatgaatagcatctatattaacatctctacatctagtgcaaatagaaacatgctcaacggtagatgtagagagtttgcaattatttaattcaacaatcttagcatgtaagatggcattctcatctctaagattggaaatagaaacattgcaaacatctaattccttagccttagcaattaatttataattctcaaacttaaggctagaaagagaggcattcaatttttcaatcttagcaattagactaacattattatttctaagattggtaattgaatcatcactaatgtttgacttctcaaccttagcaatcaaattagcattctcaattataaggttggagatagtgtcatggcaggtacttagctcactagttaatttttcatttttctctaccttctgagcataagcatttttagtcttaacatgctttttgttttccttaataaggaagtcctcttggctatccaagagttcatccttctcatgaatagcactaatcaattcatttaatttatctttttgttgcatgttaagattggcaaaaagagtaagcaagttatcctcatcatcactagaattatccttatcactagaagttgcatacttagtggaggattttgattttgccttcttcttcttgtcgtcctttgccataagacacttgtggccgactttgggtaagagaagacccttgttgacggcgatgttggcggcgtcctcgtcggaggagttggtggagctctcgtcggagtcccactccaggcaaacatgggcatcgccgctcttcttcttgtagtacctcttcttttctcttctctttcccttcttgtcgtcgcccctgtcactatcactagacaaagggcatttagcgataaaatgaccgggcttaccacatttgtagcaaaccttcttggagcggggcttgtaatccttccccctcctttgcttgaggatttggcgaaagctcttgatgatgagcgccatctcctcattgtcgagcttggaggcgtcgatggggaccctacttggtgtagagtcttctttcttctcctccgttgctttgaaatgcgacgagttgtgcctcgggtacagaggaggcgccttgctcgatgattttatttgagcctttgatcatcaattcaaaggtcacaaattttcctataacttcctcgggagacattagcttgtatctaggatcaccacaaattaattgaacttgagtgggattaagaaatacaagtgatcttagaataaccttgaccatctcatggtcatcccatttggtgctcccgaggttgcgcacttggttcaccaaggtcttgagctggttgtacgtcgcttgtggctcctccccttggtgatgcatgaagcgaccgagctcccctcgatcgtctcccgcttggtgatcttggtcacctcatctccttcgtgcgcggtcttgagcacgtcccaaatctcctttgcactcttcaacccttgcaccttattatactcctctcgacttagagaggcgaggagtatagtggtggcttgagagttgaagtgttggatttgttcgacctcctcataatcataatccttgtctcccctctttgctacctgtgctccatactcaacaatatcccatatgcttttctggagtgaggttaggtgatgcctcattttatcactccacatagaataatcttcaccatcaaacataggtggtttgcctaatgggacggaaagtaatggagtgcgttttgaaatatgaggatagagaagaggcatcttactatacttcttacgctcatggcgcttagaagtggcggatgccgattccgagccggaggtggagggtgatgaagagtcagtctcgtagtagaccaccttcttcatcttattcttcttgtcacccttgcattgggacttgatggaggaagaggattcctccttgtgcttgtgcgtggactctcttgagtgtgttctccccgagcttgcagacttgtcgccagtctcgatctccctcttggcggatgctcccgacatcactttgagcggttaggctctaataaagtaccaagctctgataccaattgaaagtcgcctaaaggggggggggggtgaataggcggaatctgaaatttacaaacttaagcacacactacaagccggggttagcgttagaattaaattcgagtccgaaagagagggaaaacaaatcaacaaggaaataaagcgaatgaacacggtgatttgttttactgaggttcagttcttgcaaacctactccccgttgaggtggtcacaaagactgggtctctttcaaccctttccctctctcaaacgatcacttagaccgagtgagcttctcttctcaatcaaccgggacactaagtctccacaaggaccaccacacaataggtgtctcttgccttgattacaattgagttggaaacaagaaagaaggaagaagaaaagcgatccaagcacaagaactcaaatgaacacaaatgtcactctctctagtcactatttgattggaatgaactttggacttgggagaggatttgatctcttgttttgtgtcttggagtgaagtctagagctcttgtattgaatgcaatggctgaaaacttggatacattgaagtgtggtggttggggggtatttatagccccaaccaccaaaaggaccgttggtgagggattctgtcgtatggcgcaccggacagtccggtgcgccaccggacactgtccggtgcgccagccacgtcaccaggccgttgggttccgaccgttggagcttctgacaactggggcatcggacagtccggtggtacaccggacagtcactattcactgtccggtgcgccttctggcgctgcttgacttctgcgcgcaggcgcgcactgttcactttcactgttcctctgcagacgaccgttggcgcgaagtagccgttgctccactggcacaccggacagttcggtgctacaccggatagtccggtgaattatagcggagcggcctccccaaattcctgaaggtgacaagttcagagtagaactccctggtgcaccggacactgtccggtggcacaccggacagtccggtgcgccagaccagggctgcctttgggttgtcttttgctctttttatttgaaccctttcttggactttttattggtttgtgttgaacctttggcacctgtaaaacttatagtctagagcaaactagttagttcaattatttgtgttgggcaattcaaccaccaaaattcatataggaaaaggtttgaccctatttccctttcaatcgatcactagtatttttataagtgcataccaccacacataactagactcgtctgtgtcaagttacccatctcatgacgttttttataatacgactaaaacaaaataaatgtcctttcactactctaagtagtggcgtaggcgtgtagctagagggtgagccgggtggaccgtcgcataccttataggccgacccaccggaccaccaaacagtctatagaagcctaataaaaaagaatgtgacatcagcttgacttacatcatcgacaaaacaaaaaatatcatgcagatcgttaggtcatttggctcctgtggttctgccacctgacctaatgagagatcgcagccacatgctgtgtgccaccacaacactgtccctgtcgctggcgagcgtcggttgggcacgacacgtctgaatttcctctggcctacgtgtagagcctcagacctcagccagagaaggtaaatttttcctcagacctcaaacagagtgtcgccgaaacgaagaaaaatgaatggtttgaccctaaaattggactttgaaaaggcttatgataaagtaaaatggccatttctccaacaggttatgcgtatgaagggtttctcaccgaaatggtgtgtgtgggttcaatcgatgaagttggtggttaaaattaatgatgaagttgttcctttctttaatactcacaaggtacattgacaaggtgatcctctttctctgattcttttcaatatagttgcgaatatgttggctatactcctctcaagagccaaggcaaataatcaatttgtaggtgtggttcctcatctagtggaggagggaatttctatcctccaatatgcggatgataccattgttttaatggatcatagcttggaacatgcgcgtaacgtaaaacttatcttgaccacttttgaacaaatgccagttttgaaaatcaactttcataagagtgagctcatttgttatggtttagctaaggactatgaacattgttactcttgtatttttggttgttgaatcggttcattaccttttaaataccttgggattcccatgatgcatcgcagactacgcattagcgagtgggagtgtgtcattgatagattcgaaaaagtttaaattcttggaaaggtaaattactttcttctggcgatcacataatgttgcttatgtgatccgcttccgattcatctgccaacaagagttttaggaaaactagatgccatccgctttcgattctaatggcaaagcggacattttaaaaagaaatatatattgacaaaatggaagctcatttgtcaacctgaggaggttggtggattgggggtagccaatttagccactaagaacattttcttactcggcaagtggctctttaagcttctgaatgaagaagatacatggtagcgaattcttaaaaataatatctaggattcaaatcacttactcaagttaggagaaggtatggagactcacattttttgtctgattcatgaatatcaaagaagaattcttgagatggggaggtttcgagcaggtgatgggcgagcaaccagattttgggatgacgaatggatcttagatagaccgcttaaagaccattttctgaatctttttaatattatgcgtaaaaaaatgctttagtcagcgatgtaatgaaagattatatactcaacttatgattttgtcgagctattgttggggtaaaataggttgggttccagaacttatcaagcttattagcaattgtctctttgcgactaccaagagagaaattactctggggcacacaaagatggatttttctctgtttgatcaatgtattctcttctaatgaatatcccccttgaattttattagtctgttttgaaaacttaaattcccttttaaaattaaaattttcttgtggtacttagggaggggcgttattctcactactaaagataacctagttaaacgcatgtggaagggtagtacgaaatatagcttttgcactcaaaacgaaactatccaacatcttttctttgattgttatcttactaggaatatatggagaatcattaacattgctttacatatagagagacccaataatattaatcatttaactcggaattggtatggtaacaaaaaaaactcataaaagaaaaaaacttctaattggggtggcagcaatgttttgatctatttggcttagccagtaacgatgtcgtcttttgtctcaaaacaataccatcaattatgtaggtttttttggaggaacatatgtcactgtgaggtccttgtagtgtgttgagcactagaggtagtggttatggagatcttctcaagacatggacggaggtccaatgctaaattagagggtgtttgagctgctattatgccctgcaaaaggctagaaaacctttcgcttccataataaaaagttgatggttataataattagctattttttacggtgcctatatgcgaggcatcccgcaagtcagcaacaagaataattgttagcatgatgtaattaggccttgatttgtggatgtaattgcgctatctacggttgtcatgcatgcaacctgtgcgctgtatatatgtactcctatttccagtattggaatacaatcaatcattcacatatttacatggtatctatcgcggttctgatccgctacgcttccgcaaccctaaccagcgctcgccgccgatccgattgccaccaccgtcgctgaccacacgtcgccgggtgtcgccggtctcatcgcccacgctgctgatccgttcctgcgttcgctatatgccgcacaggactcccgactgcgtttgtcctatgccgtttgcgcgcgagcgcgtctcatccgagcgcccaggactcccgaccgccgctgcctccgcttccaatagtgcgcagctcttccaccaccgtcccgtgccgaatcgcgcataggatttacgccgccgtcatcgcgtgatgggcttccgccgttgtctcgagccggaaccgcgggcgcgtcctcacccgagcactgcccctgcttccatcgcgcgcaggacatccgggcgcgtcctcaaccgagcgagcagtcgcgtgctgtgctgtttgcgcgcgagcgcgtctcattcgagcgtctccaccgctgcgccgccactgctccgttagcgtttaaactctgcctgttctgctcgccggggatttccctgatccgtcgggagtcgggacccattcctgcctgcgtcaccatgctcaggctgcgtcagagactcagaggggagcagccgcgtgtgcaccagcacacgaccactcccatggtggatgacgccgacgcgactgccgccgccgcgacggctcaggaaaccgaagcccgcgccgaggccgagctccgtaccgaagcggcacgcctccacgctgcagccctcaccaattttgaagccgcccatgaggctatctaggcataggccaccactgtcgtcaacgtcaaggcgctgatccccatcatcctcaacaaggctaccaacacctacaccaaatgcgtgtggcatgttcctcaccgtgctcggcaagtacgcccttaccccgcacgtcctcgaggacgcgacacatcccaatcgccctgtttgggtccagacggattgcgtcgtcttgtcatggatcttcaccaccatctccggcgacctctagcagtcgctcatgatccgcccacgccacgcacgcgaggcgtggtgctaccttgaggatgcattcctcggccagaaggagtctcgtgcccttctcctggaaacacagtttcgcaacctccatcaagactccatgacgatcaccgacttttactgcaagttggagaccatggatgcgtctcttgccgaattcggtgatcccatcggtgaccgccagatggtgctcaccatccttcgtggactcagtggtaaattccatcacatggtgtctattttgaagatgcagcgttcgtttccgacgttcgtcgaggcccacatgcacctgctccatgaggtggtcgacgtcgacgccctcccaccgtcctcgcctgcagccctcatcgcctcgtcgcccatgacgcctgctggtggccaggaccaccatgtgcaggcctctgctccaccgcgctctagtcaacctggccagccaggaggccaacgaaacggccgccatcgcgacaagggtggccatgggcagggcagccatcctggcgctggccaaggtggccacggtcctcctacgggcggccacggtgccccggctacgcacggccacgtcgcaccggctggtcagggtgtcgtgcacccctccttcgcacacccatgggccggcacgctccagatgtggtcctacgggcgtccgcctccggcaccgccggccttcaccgctgttccccagtacgggccacccttcggtggtgcccccagcggcaacctctacggcaacggccccggccatccgtatgtctacgggggaggaggtgcaccctcgacgccgatgtttcagggggcatcataccagctgccggttgccccctagaatctcgcacatggaggtgcatggaaccaggactccctggtgcagaacttcaacaccatgacgctcacccctctggcaccatcggagtggtacaccgactctggtgctggctcgcatatgactgcggatgctggtaaaatttccaccctatcctcgcccacattctccacaccttcgtctatcattgtgggcaatggtgctttactttctgtcactgccatcggatcacatactttttcttttccacatcgcaatctagttcttaacaatgtcttagtttcacctcacattattaagaacttgatttcattcgtcgttttaccaccgacaataattgctccatcgaatttgatatgtttggtctttctgtgaaggatttggaaaccaggaacgtgatcgccaggtgcaatagctctggcgacctctatccatttttttctccagccaccagcacctccgcattcctcgctgcacccacctcgctatggcaccgtcttcttaggcatcttgggcatgaagttttgtccaaactcattagttccaaagccatctcgtgtaataaagatgatagtcaccatttatgtcatgcgtgtcagctcggttgacacactagacttccttttggttcctcaaattctcgagctacaaataatttcgatttaatacattgtgatctttggacatctcctattgttagtgtgtcgggccacaaatattatcttgtcattttagatgattgctcacactacatttggactttcccgcttcgcctaaaatccgacacatttgccactctctctcacttttttgcttatgttcgcacgcagtttggcaccaccatcaaaagcgtccagtgcgacaatggccatgaatttggtaattccccggcccgcacgttctttctttccaacggtgttgcccttcgcatgtcgtgcccttatacatcccagcaaaatggcaaagctgagcgctctcttcgtaccattaataacaccttgcgctcactcttatttcaggcgagtcttcctccggtctactgggttgaggcacgccacactgccacataccttatcaaccggctccccaccaaaaccctcacctcctccacccctttcttccacctccacaccactacaccttcctatgtgtcggggaccataattaggggtaccctcaagactcctaattctcagctggtaacccccatcagcacaaagctgcaaaggcctgatgggtgcgactaagccagggatcggtccattcgagggactcgatcacgcctcacccgagcccagcctcgggcaagggcagccgaccccggaggatctccgtctcgcccgaggcccccctccagcgacgaacatacttccggctcgcccaaggcccagtcttcgccaagaagcaaccctggccaaatcgccacgccaaccgaccaaatcgcaggggcatttaatgcaaaggcggtctaacacctttatcctgacgctcgtcctccagtcgacagagccgaagtaaccgcagtcacttcgccgctccactaaccggcctgacagaaggacagcgccgcctgcgccgctccgactgctgtgccactcgatagagtgaggttgacaggcagtcaggcccggcctcaggcaccataggaaactctgctccgcccgacccagggctcggactcgggctcaaccctggaagacggcgaactccgctctgcccgacccagggatcggactcgggctcagccccggaagacggcgaactccgctccgcccgacccagggctcggactcgggctaagccccggaagacggcgaactccgctccgcccgacccagggctcggactcgggctcagccccggaagacggcgaactccgctccgccggacccagggctcggactcgggctaagccccggaagacggcgaactccgctccgcccgacccagggctcggactcgggctcagcccctgaagacgacgaactccactccgcccgacccagggctcggactcgggctcagcccctgaagacgacgaactccgcttcgcccgaccccagggctcggactcagccctggcctcagccgacggtctccgcctcgcccgacctaggggctcggactcgacctcggccccagaagacagactcgacctcgacctcggaggagcctccgcatcgcccaacctagggcgcggaccgaccacgtcaataggaggcaccatcattaccctaccccaagctgactcaggctacggggaacaagaccgacgtcccatctggctcgctccgccagacaagtaatgatggcgccccgcacgctctatgacgacggcagctctcagcccccttacggaagcaagaggacgtcagcaaggactcgacagctccgacagctgtccttccgccaggctccagcgctcctccgacggccacgacaccacacgaaccgggtgccaaaacctctccggctgccacgatggcatgtacttagggcgctagctctcctccgctagacacgttagcactctgctacacccccattgtacacctggatcctctccttacgcctataaaaggaaggaccagggccctcttacagaaggttggccgtgcggggaagaggacgggacaggcgctcgcgtgaggccgctcgctccccctcccgcgtggacgcttgtaaccccctactgcaagcgcacccgacccgggcgcgggacaaacacgaaggccgcgggatttccacctctctctctctctctcgctccgaccgccttttccccccttcgcgctccgtctcgcgccgacccatctgggctggggcacgcggcgacatttcactcgtcggcccagggaccccctggtctcgaaacgccgacagttggcgcgccagttaggggcctgctacgtgttgacgaatagcttcccgtcaagctccagatgggcagtctccagcaacctttccagcccgggacgatgctccgtttcgggagtcttgagttcatgtccctcgacggcagctacgacatgatactccttcccccgccgtgcgacagcgacgatggcggccgacagcccgcccgccggcggcggaatcgacgacgtcttccccgcgtggtggaagaacaacattcgagctcaccccgccctctcccccgccgacggaggaggaggcagggcaaccaaggccaagcaggaggcgacacctcgtcggctgtcgagcaagtcgacggcgccggcgccccaacggggggcgcgtcgggcatcgacctcgcgtttgagacgaagacgagcgccgtctccctgcaacacgccaattccgagcaaacggacgacgccagcacgctcgcgaaaggcttgctgggcgtcaccctcgtacctgagacgacggtgcagtcagtccctgacgtgacttcgtcaccacccgtcgaccaagaggtacccaccggttcccatctcacgccctttggattcagcctcgacctgccaagcgacttcgctttggcggacgctctcatagaggcgagtccaaaccctctggggtttcgtatgcggtcaccctaggaccggctcacggacgtctcgacctacaggccctcggggtccgaggaagatgacgagcccgatttctgttgggatttctccggacttggtaaccccagtgccatgcgggacttcatgaccgcatgcgactactgcctttccaactattccgacggtagccgcagcctcggcgacgaggactgcggcccaagtcgtgaatgtttccacgtcgatctagggggccctccgaaggcaaccatctcggtatgccggagaacggtgatctccctaggcctgtgcctcgcgttgacatcctacgggagctagctatggtccccgttcaggcggggggtcatgacccacagctcgagcaaatccgcggggtgcaggccaggctcgacgagggagcaggaacgcttgagccgatccgccgggacatcaggcaggaatgggcgggccaacctccggccggagaagtgcgccatctacccagggtatccagcaccgcatcgccgacaatgtcagggtgaggccgccacccgcttctagtggagtcggctagaacctggctgcagcagcaatgcttctccgtgcgatgccagagccatcaaccaccgaggggcggcgaatccagggagagctcaagaatctcctggagggcgccgcggtccgacgggccgaaagctccgcctcccgaaggcaggggtacccctcggaacatcgcgccgcgacttcccgattcatgcgggaagcctcggtccacaccgggcgcacgcgcaacacagcgcctgcggccccgggtcgcctcggcgacgagcaccatcaccacgaccgtcgagcccacctcgacgagagggtgcgccgaggctaccaccccaggcgtgggggacgctacgacagcggggaggatcggagtccctcgcccgaaccacccggtccgcaggctttcagccgcgccatacgacgggcgccgttcccgacccggttccgaaccccgactactatcacaaagtactcgggggagacgagaccggaactgtggctcgcagactaccggctggcctgccaactgggtggaacggacgatgacaacctcatcatccgcaacctccccctgttcctctccgacaccgctcgcgcctggttggagcacctgcctccggggcagatctccaactgggacgacctggtccaagccttcgccggcaatttccagggcacgtacgtgcgccctggaaactcctgggacctccgaagctgccggcagcagccgagagagtctctccgggactacatccggtgattctcgaagcagcgcaccgagctgcccaacatcaccgattcacatgtcatcggcgcgttcctcgccggcaccacctgccacgacctggtgagcaagctgggtcgcaagacccccaccagggcgagcgagctgatggacatcgccaccaagttcgcctctggccaggaggcggttgaggctatcttccggaaggacaagcagccccagggccgcccaccagaagatgcccccgaggcgtcaactcagcgcggcgccaagaagaagggcaagaagaagtcgcaagcgaaacgcgacgccaccgacgtggaccttgtcgccaccgccgagtacaagaaccctcgaaaaccccccggaggtgccaacctcttcgacaaaatgctcaaggagccgtgcccctatcatcaggggcccgtcaagcacacccttgaggagtgcgctatgcttcggcgccacttccacagggccgggccacccgcggagggtggcagggctcgcgacgacgacaagaaggaagatcaccaagcaggagagttccccgaggtccgcgactgcttcatgatctacggtgggcaagcggcaaatgcctcggctcggcaccgcaagcaagagtgtcgagaggtctgttcggtgaaggtggcggcgccagtctacctagactggtccgacaagcccatcaccttcgaccaagccgaccaccccgaccacgtgccgagcccggggaaatacctgctcgttgtcgaccccgtcatcggcgacgtcaggctcaccaaggtcctcatggacggaggcagcagcctcaacatcatctacgccgagaccctcgggctcctgcgtgttgatctgtcctcggtccaggcaggcgctgcgcctttccatgggatcatccccgggaagcgcgtccagcccctcggacaactcgaccttcccgtctgcttcggaacaccctccaacttccgaagggagaccctcacgttcgaggtggtcgggttccgaggaacctaccacgcggtactggggaggtcatgctacgtgaagttcatggccgtccccaactacacctacctcaagctcaagatgtcgggccccaacggggtcatcatcgtcggccccacgtacaaacacgcgttcgaatgcgacgtggagtgcgtggagtacgccgaggccctcaccgaatccgaggcccccatcgccgacctggagagcctctctaaggaggtgctagacgtgaagcgtcacgccggcaacttcgagccagtggagacggttaagtccgtccccctcgaccccagcagcgacgcctccaagcagatccggatcagctccgagctcgatcccaaataggaagcagtgctcgtcgactttctccgcgcaaacaccgacgttttcgcgtggagtccctcggacatgcccggcatactgagggatgtcgccgagcactcgctggatatccgagctggagcccgacccgtgaagcagcctctgcgctgattcgacaaagaaaagcgtagagccataggcgaggagatccacaagctaatggcggcagggttcatcaaagaggtattccatcccgaatggcttgccaaccctgtgcttgtgagaaagaaaggagggaaatggcggatgtgtgtagactacactggtctaaacaaagaatgtccgaaggttccctaccctctgcctcgcatcgatcaaatcgtggattccactgctgggtgcggaaccctgtctttcctcgatgcctactcaaggtatcaccaaatcaggatgaaggagtctgaccagctcgcgacttctttcatcacgcccttcggcacgtactgctatgtcaccatgccgttcggcttgaggaatgcgggtgcgacgtaccagcggtgcatgaaccatgtgttcggcgaacacattggccggacggtcgaggcctacgtcaatgacatcgtagtcaagacgaggaaagcctccgacctcctttccgaccttgaagtgacattccgatgtcttaaggcgaaaggagtgaagcttaatcccgagaagtgtgtctttggggttccccgaggcatgctcttggggttcatcgtctccgagcggggcatcgaagccaacccggagaagatcgcagccatcaccagcatggggcccatcaaagacttgaaaggcgtactgagagtcatgggatgtcttgcgactctgagccgcttcatctcacgcctcggtgaaagaggcctgcctctgtaccgcctcttaaggaaggccgagtgcttcacttggacccctgaggccaaggaagccctcgggaacctgaaggcgctcctcacgaacgcgcccatcttggtgccccccgctaccggagaagccctcttgatctacgtcgccgcgaccactcaggtggttagcgccgcggttgtggttgagagacgagaagaggggcatacattgcctgtccagaggccggtctacttcatcagcgaggtactgtccgagaccaaaatccgctacccacaagttcagaagctgctgtatacggtgatcctaacgcggcggaagttgcgacactacttcgagtctcacccggtaactgtggtgtcatccttccccctgggggagatcatccagtgccgagaggcctcgggtagaatcgcgaagtgggcggtggaaatcatgggcgaaacaatctcgttcgctcctcggaaggccatcaagtcccaggtcttggcggacttcgtggctgaatgggtcgacacccagctcccaacagttcagatccagccgaaactctggaccatgttcttcgacgggtcgctgatgaagacaggagccggcgcaggcctactcttcatcttgcccctcgggaagcacctacggtacgtgctacgcctccatttcctggcatccaacattgtggctgagtacgaggctctggtcaatgggttgcggatcgccatcgagctaggggtccgacgcctcgacgttcgcggtgactcacagctcgtcatcgaccaagtcatgaagaactcccactgccgcgacccgaagatggaggcctactgcgatgaggttcggcgcctggaagacaagttctacgggctcgagctcaaccacatcgcccggtgctacaacgagactgcagatgagctggctaaaatagcctcggggcgaacaacggttcccccggacgtcttctcccgagacctgcatcaaccctccgtcaagatcgacgacacgtccgagcccgaggcaccctcggcccagcccgaggcaccctcagctcggcccaaggcacccttagtttagcccgaggtattctcggcccccgagggtgaggcactgcacgtcgaggaggagcgaagcggggtcgcgcctaatcaaaactggcagaccttgtacctgcaatatctccaccgaggagagctacccctcgaccgagccgaagctcggcgattggcgcggcgcgccaagtcgttcgtcttgctgggagatgggaaggagctctaccaccgcaacccctcaggcatcctccagcgatgcatttccatcgccgaaggccaggagctcctacgagagatacactcgggggcttgcggccatcacgcagcacctcgagccctcgttggaaacgctttccgacaaggttttgtactggccgacggcggtggccgacgccactagaattgtccgcacctgcgaagggtgtcagttctacgcgaggcagacccacctgcccgctcaggctctgcagacgatacccatcacctggccttttgctgtgtggggtctggacctcgtcggccccttgcagaaggcacccgggggctacacgcacctgttggtcgccatcgacaaattctccaagtggatcgaggtctaacccctaaacagcatcaggtccgaacaggcggtggcgttcttcaccaacatcatccatcgttttggggtcccgaactccatcatcaccgacaacggcacccagttcaccggcagaaagttcctggacttctgcgaggatcaccacatccggatggactgggcagccgtggctcaccccatgacgaatgggcaagtagagcgtgccaacggcatgattctacaaggactcaagcctcggatctacaacgacctcaacaagttcggcaagcgatggatgaaggaactcccctcggtggtctggagtctgaggacaacgccgagccgagccacgggcttcacgccattctttctagtctatggggccgaggccatcttgcccatagacttagaatacggttccccgaggacgagggcctacaccgaccaaagcaaccaaactagtcgagaagactcgctggaccagctggaagaggctcgggacatggccttactacacttggcgcggtaccagcagtccctgcgacactaccacgcccgaggggtccggtcccgagacctccaggtgggcgacctggtgctttggctgcgacaggacgcccgagggcggcacaagctcacgcctccctgggaagggccgttcatcatcgccaaagttctgaagcccggaacgtacaagctggccaacagtcaaggcgaggtctacagcaacgcttggaacatccaacagctacgtcgcttctacccttaagatgctttcaagttgttcatatacctcgctcccatgcaaagtttagtcatcaaggaagggtcagccttgcctcggcaaagcccgaccctccctcgggggctaaaaggggggaaccccctctgcgtcgaaattttcctcgaaaaaaaatcctttctgccagaatgtctttcgtgcttttcgactacttcgaaagtggatcataaaaacgacggagtacacgtaagcagccaaggctgaccgagccgagggactcctacgcctccgggatatggatacctcactcatcaccttctgcgataagtaactcgcgttcggataagtgattccgcggactgaacaagtcttcacgttcgaaagcccctctgccgaagcgattcttcgggccttctcgactgcatcggtgacagaaccccatggatgggcaagagcgcgcgtaagcggcaaggccgaccgagccgagggattcctacgcctccgggatacggatacctcactcatcaccttccgtgaaaagcaactctcgctcgcacagacaattctgttaccaacggaaaagtccagatactcgaaacaagaggaaaagaagcgcagctttacaacacggtgatggtgtgtttgggcctcggcggccgcagaaaacgcacactacaagataatccgatcctgcaggctcggatcttgatagttgaagggagcagcagcaccctcggcgtcgactacaccttcggtgaggtccgacctagcctcggacggcgacgcgatccgaggatccccactctgaaggacgacttcatcatcacgcccgggccatcgccgcctgggtctcctccaagaatccggctcgagcaggcggctcggctggacaccccgaggcctcggccagctgtcccccgaagacatcagcccggcccgaggccacggcagatcaactccggcatcggtcccgctaacggacgacccagccaggctccgaccgaccaagtcttcttttcgagccaactctgcctctgtccgtgctgacaccgctacccctggcttcggctcatcgaagagcggccgaggggttcctttaactaagcaagagaagcctcggatagcaaggccgaccgagccgagggactcctacgcctccgggatacggatacctcactcgtcacctttgcacggggcgactcacgcttggtgaagcggttcagacaaccaacaggcgagtcttagtgctcgaaaatgaggaaaaaacacggctccgcgccaaaaatacatacacgttcaggccccgacagccacaatgaacaaaagaccgacattcaaggtgccactacaagcggaaccccggttccacctccgcaggtacgaacaaccccacacgattggggggcctgcggagcaacagaagaccgacggacggctcaccgtcgcccgctccagcagcggcgacaacgacgacttctgctccgggggtccgaacagcagcagcgatgacctcagggcggatgctgctgccgtgaggccctcgcccgtgcccaaactcgtgaggcaaggacgggcagaaggccgtagagttggaggttggtccgtgggcggccccggctatctcgtcggcggaaaaacctcttccagctgccgtggcggaaggcggcgccgggagcggctccgaagccactcgggtcagagagccaggcacgcggcaattgccagcgccacgaacggcgaacgcccttccccccgatcactgagggaaggagcgggccgccgcccgcgctggggccgaccccaactcggcacactcccctccctagcgctaatgatgaaaatccttgaggctgagggaggggcagaggccgcagcccggcttgctttcccccgccatcgaactggaggtcaccgtcttgggtgaccgccagcggaggggtgtagccgggctgcatgatgaaaatccttgaagccgaacgatggctgaaaggtaccaactcccacagagttgggttcctccaacgataaggcggaaggattgcgggtgtcccccatccgggggctcggaaggtggaaagatacgatgcataagggagcgcgaagacatggtcgcctttcaagggggtcaccctccttttaaaggcaactctccctacatgcgtccccagccgtcgtgggctgagtcttctccaacacgctccaaggtcctccccctacggcgcgggggctgggtcccacgcgtcatgcaagctgacccagagcgggaggagccaaaccgccgcgcgcggtgcatgcaaccgcccagcggttacgagcattcctccaccttcgcccagaccagcgggcgaaagggcgggcagccatgcaggcggcatgcaatcgcgccaagtgggtgcgcccctctgacttccaacgcacccagcatgggggcccacgcccacgagtcatgcaaccggcgcgccggtcgctacgtgcaagcaactgcaccgccactcgcaccactgccacgcctcctcgactgcggaactagtaccgcgactcgaggcaaccctgcgtacgacctagcagtgccagccaggcgcgacggtcaatacggccaaaaatgggccggcagtaatggcggtggcaggcgggcaggagcagcggtcacgtcgtcagccaagctcacgtcctgtccaggggcagcgagagaaccctctctcacggcgtgaagaaggcgcgcctgtgttccgttcctcgaacggctcgcgcacgcgcaacggccgccccgcgaaccactcgccccgtcgcattaactccgcggcgggacaggcggcgcctctggcaggggaagcgagcggcgcttcgccttcgccataatgaccgcgtcaaaaaaggtacgccacgtcattcgatttcgcatccttttccttttcctctttctctctcttacaacagggaccgggaaagggggataccccgaaaaggatccttctctgtgaaggaaacaggctccgagcctccctactgatcagaggttcaaaggctggcccctcggaggggtttaacagccgcctcagagcgcgtgggctccacacccactactggtcagaggttcgaaggccggcccctcggaagggttcaacggccgcctcaggccacttgggctccgcgcccactactgatcaggggttcgaaggctggccctcgaagggttcacagcagcctcagacatagagcgagggatgaccctgggtacgttcgatacataaccaaggctcgggctacgctcccgaggtaccctaggacatttccgagaccagcgggaacgatcttgtaacggaatcccatcagagggaggcatcgagccctcggaccccgtcgacaggggaccgggtccggcagatcacccgcaggtacttttgggcgcgcctctgggcctctagccgacccctaacaaatggggcacggacgtccgctcggattacccgtcaacagctcaccggagacaccatgttcggcgccctccgagggcaacatggcgctttcccccctcctccttgcaaaaaggcgacgcaggggcgtatgtaaaaaagtcgagtctgtccctgaccgtcctctcgccttgtgcagaggctcgggggctgctctcgcaaacccggctccggccaaaccgttgatagcgtcaacataccagcccgagaacttgggacccgaccgtgcacccgggctacggccagctcgcatgagggaatgaccagaccagccgaggcattgcgcgaggcattaagacctcggaggagtcaaaccacccctccgaggcctcgggggctacacccggcgggtgcgctcgcgcgcacccaccggaacaaaacgcaaccgagaaaggctggtcccctcgcaaaaaagtgcgacaaaagcctccaagcgagtgttaacactcccttcgaggctcaggggctactgtcggggaccataattaggggtaccctcaagactcctaattcttagctggtaacccccatcagcacaaagctgcaaaggcctgatgggtgcgactaagccagggatcgacccattcgagggattcgatcacgcctcgcccgagcccaacctcgggcaagggcagccaaccccggaggatctccgtctcgcccgaggcccccctccagcgacgaacatacttccggctcgcccgaggcccagtcttcgccaagaagcaaccctggccaaatcgccacgccaaccgaccaaatcgcaggggcatttaatgcaaaggcggcctgacacctttatcctgacgcacgtcctccagtcgacagagccgaaatgaccgcagtcacttcgccgctccactgaccggcctgacagaaggacagcgccgcctgcgccgctccgactactgtgccactcgacagagtgaggttgacaagcagtcaggcctggcctcaggcaccataggaaactctgctccgcccgacccagggctcggactcgggctcaaccccagaagatggcgaactccgctccgccccacccagggatcggactcgggctcagccccggaagacggcgaactctgctccgcccgacccagggctcggactcgggctaagccccggaagacggcgaactccactccgcctgacccagggctcggactcgggctcagccccggagacggcgaactccgctccgcccgacctagggctcggactcgggctaagccccggaagacggcgaactccgctccgcccgacccagggctcggactcgggctcagcccctgaagacgacgaactccgctctgcccgacccagggctcggactcgggcttagcccctgaagacgacgaactccgcttcgcccgaccccagggctcggactcagccctggcctcagtcgacggtctccgcctcgcccgacctaggggctcggactcgacctcggccccggaagacagactcgacctcgacctcggaggagcctccgcatcgcccaacctagggcgcagaccgaccacgtcaacaggaggcaccatcattaccctatccccaagctgactcaggctacggggtacaagaccggcgtcccatctggctcgctccgccagacaagtaatgatggcgccccgcacgctctatgacgacggcgactctcagcccccttacggaagcaagaggacgtcagcaaggactcgacagctccgacagctgtccttccgctaggctccagcgctcctccgacggccacgacaccacacgaaccgcgtgccaaaacctctccggctgccacgatggcatgtacttagggcgctagctctcctccgctagacatgttagcactctgctacacccccattgtacacctggatcctctccttacgcctataaaaggaaggaccagggccctcttacagaaggttggccgcgcggggaagaggacgggacaggcgctcgcgtgaggtcgctcgctcccccgcccgcgtggacgcttgtaaccccctactgcaagcgcacccgacccgggcgcgggacaaacacgaaggccgcgggatttccacctctctcactctctcgctccggccgcctttttccccccttcgcgctccgtctcgcgccgacccatctgggctggggcacgcggcgacatttcactcgtcggcccagggaccccccggtctcgaaacgccgacactatgaacacctcaaagttttcggttgtgcttgttacccaaacatgtcctctacagcagcccataaactcgctcctcgttcatctctatgagtcttcctcggctactcctcagagcacaaaggctatcggtgttttgagcttgagtcgaatcgcattctcacctctagacatgttgtttttgacgaatcctcctttcccttcgccaacatgtctacctcacccctgacatcctccgccttggattttcttctagatgacagtgatctcactgctcctcttcctagagcaacgtttgcccgtgcaggtactgctgatagggcagttgaggctcctgcgcccctcactcgccaccgagcgctgccccgcggtcaccacagctgcgtgctgggcatggggcgcccagcctcgtagggccgtccaccagtgctgcccctagcagtgcaccccttgtgcccccggtcggtgttgctgcccctatgccccctgcacaggtcattgccagcagcgccacggccatcgggcgcacggtcttcaccaagtcggtctccatcgtccccatcgtcaacaagcactccatgcgcacccatggcaaatccggcattacacatcctgtggatcatctcaacccccacgttgtgctaatgtcgccattgcctcgctccgttcgggatgcccttgcggatccaaattggcgctcagctatgcaagctgaatatgatgccctcatggctaatgacacctggagtttggtaccacgtcctcgtggcgtcaatctggttactggcaagtggattttcgagcacaaacttcatgcagatgggtctctcgatcactacaaggctcgttgggttcttcaggggtttacacaacgacctggtcttgattatgatgagacattcagcccagttgttaagccaacgacaattcacgttgttctctctctggctctctctcaggactggcccatccatcagttagatgtgaagaatgcattcctacatggcaccctcaccgagaaagtgtactgtgtgtagccttttgggtttgtggactcctctcgctcagatttggtttgtcggctaaacaaatatctgtatggactgaagcaggctcctcgtgcatggcatcacaggttcgcctcatatctctcctccattgggtttattgaaaccaagtcagatagttctttgtttatttgttgtcgagggttcgacactgcttatttgttgctctacgtggatgacatcgtcctcaccgcctcccctgtcgagtttcttcgtcaagttattggggctctctagcatgagtttgcaatgacagacatgggtcagcttcaccatttcttgggcatctctgtcacacgctcaacacatggcctgtttctttctcagcggtagtacactcaggatattttggagcgcaccgggatgagtgtgtgcaaaccttgtagcacgcctgttgatctcaactccaaactatctgcagatggacctcctgttggtgatgctactcagtaccgcagtctggtaggagctcttcagtacctgacctttacacgtcctcacattgcttttgcagttcagcagatttgcctctatatgcatgatcccagggagcctcaccttgctgctcttaagcgcattctgagatatcttcaaggcaccacagactttggtttgactatgcgtcgttctcccccgttggagctggttgtctacacggatgccgactgggctggatgtcccgacactcgacggtcaacttctggtcatgctgtgttccttggagataacctggtgtcatggtcctccaagcgacaacacacgttctcacaatccagtgccgaggcctgagagcacctagaggggggtgaataggtgatcctgtaaaattcaatactaaatagccacaagcttggttataaagatgttagtgcaatagaaccaagtggctatagagcgagctcttgtgaatcacaataatcacagagaaagacaacacaagagacacagtggtttatcccgtggttcggccaagtataacacttgcctacctccacgttgtggcgtcccaatggacgagggttgcactcaacccctttcaagtgatctgatgatcaacttgaataccacgatattcttccttatagttttcttcccgtttgggaggaatctccacaagttggagcctctcgcccttacaagattgatcacaaagaaagcacagagtaaggttgggaagagcaacgcacactagaattaaatccacaccacaaacacacacacaagtgagaagatgagcacacaaaacacgcgtggggagtttgcaactcgaaaagtgctccaatctcaagaacaatgaacgattgcgtgaaagtgaggactagaagtcttggaatgcttagagtgtgcttgggtcgctcctccatgcgcctaggggtcccttttatagccccaaggcagctaggagccgttggaggccaacaaggaaagttatccttgccttctgtcaggtggtgcaccggacagtccggtgcaccaccggacagccactgttcatgtccggtgcgcgatctccttcctattctggcgcagccgaccgttgcagatttgtggcagttggcgcacataacactgtccggtgcacaccggacagtccggtgccctctgccgaccgttggcgcgggccacgcgtcgcccgcggattgcgtggtcgaccgttgcgctagtggccgttggctcaccggacagtctggcgcaccaccggacagtccggtgaattatagccgtacgccgccaaattctcccgagagcggcctattcaccggaggatggtctggcgcaccggatactgtccagtgcaccaccgaacagtcgagtgtgccagaccgagcaggactttggctgtaccaaggcaagtcatttgcaattcttttcttcttttcttctcactgtttctagcacttagataaaacatattagtacttaaaaactatgtactaagtctataaacataccttctctttgatttgcacttctcttcttcatttagctcattagaacttatttaaatgtgttgagcacttaatcaccaaaacataaatagaaattgcctaagggcacatttccctttcaatccccccctttttggtgatttatgccaacacatcaaaaagcaatgcaaaacatgcaacatcgattcaaattgaagaccaaattgtttttgactctaatttgacatatttggatcattctttgccaccacttggtttgtttttgcgaatcaaattcatttccaatctttaagtcaaactcacttgtttgggcataaaaagagatattccaagagtgaaaatgatcaagataaaaaaactccccctttttcccataatcataaatttttcccacaagagaccaaattttgcaatgagagtattttggcaaaccaaaaattctaactctactattttcaaaattctcaagtggtagctgatccatttgctttggccttaatttctccccctttggcattaagcaccaaaatgggattattttttgccctttaaccccattgcctcaccaaaattgttaattaagagcaaaacaacaatatgatcataagaatgaacttggaggtgtgtacactaataccggagtgcagtggaagtctttgcatggtccaagttcacctttccctttcaattcacctttgagactacatcaagtacacttaaacacacatgttagtctcaaagggtcaagttgtagcacttctcccccaaaatatgtgcatcattcacacatggacttatgaggtccgggaatcccttgcacaacttgagcaccataaataagcaacaaatgatcaaaggcataaaatgcatgtatgctatagatcaatccaagttacgcgaatctaagacatttagctcacttcgcagcctgcaaaatgttttctcatctaaaggcttggtaaagatatcggctagctggttctcggtgctaatatggaacacctcgatatctcccttttgctggtggtctctcagaaagtgatgtcggatgtctatgtgcttagtgcggctatgttcaacaggattatccgccatgcggattgcactctcattgtcacataggagtgggactttgctcagattgtagccaaagtcctagagggtttgcctcatccaaagtagttgcgcgcaacacagtcctgcggcaacatactcggcctcagcggtagatagggcaacagaggtttgttcctttgaactccaagacactagggaccttcctaggaattgacacgtccctgatgtactcttcctatggaggggtgcatccagcataatcggagtctgaatatccaatcaagtcaaaggtaaaccccgttgggtatcaaatcccggagcgaggcataacaactaaatatctaagaatccgcttaacggccccaaagtgaccttcccttggagtccaattgaaatctaacacaatgcatagctaaacagagagtcccggtctactaccccataaataaaataaaccccccaccaaaaaccgagnnnnnnnnnnnnnnnnnnnnnnnnnnnnnnnnnnnnnnnnctggagctaggcatagcaattaatatttaaggatccgctaaacggccacagggtgacattcccttgggtcagattgaaatctagcacacatgcatacgctaagcataatatccggtctactagcacataaataaagtaaagaccctatcatagaccggtatgccttttgatcaacggacttacctcctttgttgaggtcgacatgtccgtcggttcccattggtgtcttcgcgggttggcatcctttatcccaaaccgcttgagaagatcttgtgtgtacttcgtttgggagaggaaagtgccatccttgagttgcttcacttggaacccaaggaagtacgtcaactcgcccatcatctacatctcaaatttctgtgtcatcaccctgctaaactcctcacaagacttttgattagtagaaccaaatattatgttatcgacataaatttggcacacaaagaggtcaccgtcacaagtcttagtgaaaagggtgggatcggctttcccaaccttgaaagcattagcaattaagaaatctctaaggcattcataccatgctcttggggcttgcttaagtccatagagcgccttagagagcttaaaaacgtggtcaagatacatgtcatcctcaaagccagggggttgttccacgtacacctcctccatgattggcccgttaaggaaagcgctcttcacatccatttgaaacaacctgaaagagtggtgagcggcataggctaataatattcgaatagactctagcctagccataggagcaaaagtctcctcgaaatccaaacctgcgacttgggcataaccttttaccacaagtcgagccttgtttcgtgtcaccaccccgtgctcgtcttgcttgttgcggaacacccacttggttcccacaacattttgcttgggacgtggcaccaggctccaaactttgttcctcttgaagttgttgagctcttcctgcatggccaacacccagtctggatcctgcaaggcctcttctaccctgaaaggctcaatagaggagacaaacgagtaatgctcacaaaagttagctaatcttgagcgagttgttactcccttgcttatgtcacccagtatctgatcgacggggtgatgtcgttggatcgttgctcggacttgagttggaggggccagtggtacttcttcctccatcacttgttcttcttgtgctcccccttgatcacacgcctcttattgatgaacctatccatcatcttgatttaggggatgcaccatcgttgaggaagaaggttgatcttgctcttgttgttcctgaggtcgcacctctccaatcgccatggtgcgtattgcagccgttggaacatcatcttcatctatatcatcaagatcaacttgctctcttggagagccattagtctcatcaaatacaacgtcgctagagacttcaaccaaacccgatgatttgttgaagactctatacgcctttgtatttgagtcataccctagtaaaaacccttctacagctttgggagcaaatttggaatgtctacctttcttcaccagaatgtagcatttgcttccaaatacacgaaagtaatgtacattgggtttgttaccggtaaggagttcgtaggaggtcttcttgaggagacgatgtagatagagccggtttatggcatggcaagctgtgttcacagcttccgaccaaaaccactcgggcgtcttgaactctccaagcattgtcctcgccatgtcgataagcgtcctgttcttcctctctactacaccgttttgttgtgctgtgtagggagcagagaactcatacttgaccccttcctcctcaagatactcctcaacttgtaagttcttgaactcggacccattgtcactccttatcttcttcactttgagctcaaattagttttgagccctccttagaaagcgctttagggtcccctgggtttctgatttatcctgcaaaaagaacacccaagtgaagcgggaaaagtcatctacaattacaagaccatacttacttcccccgacgctaaggtaggcgacgggtccgaagaggtccatgtgaagaagctccagcggtcttgatgttgtcatcacattcttgctgtgatgagtgcttcccacctgtttccctacctgacaagctgcacaaggtctatctttttcgaaacatacattggttagtcctaacacatgctctccctttagaagtttgtgaaggttcatcatcccaacatatgctagacggcgatgccacagccagcccatactagtcttagcaattaagcttgcatctagatcgacctcctctttcgaaaaatcaactaagtagagtttgtcatctagtacacccttaaacgctaatgaaccatcactccttctaaagacatatacatcaacatttgtaaacaaacaattgtagcccatgtggcacaattgacttacagacaggagattatagcctagcgactctactaaaaatacattggaaatagagtgctcgcttgtgatggctatttttcccaaacctttgaccttgccttgatttccatctccaaatatgattgtatcctgggaatccttgttcttgacataggaggtgaacatcttcttctcccccgtcatgtggtttgtgcatccgctgtcgatgatccagctttagcccccggatgcataaacctgcaaggcaaattaggcttgggttttaggtacccaactcttgttgggtcctataaggttagtcacaattgcttttggtacccaaatgcaggccttgtctcctttgcatttggatcccaattttcttgcaaccactttttcatttttacatgaaagtacaaatgtagtgttgcaagcatgaaagacaatagtaggtttattacatattttcctaggagcatgagacacaaaatttctcctaggcctaccattaaaattagaacttgaagcaaacatagcatgtgattcacaagcatcatgatcatatctccttgtcggagggtaaatctctctggccgggtggcggattgcacccgccctaattcctaaaatgaggaggggcctaagcgtcttgcttgttacgaggttggtgaatgaacacacgagagcacacgggagtttagagtggttcgggccgccggggcgtaacaccctactccactgtgtaatgtattgtgagtctgagcctaaggttggatctgtcttgtaatgtcgcatgcctccccttttatagctgaatgggggcacgcacaaaggcactgagccccgacatacgggcccagcaacatagagaacataacacttgggactataattatttgctgccggggcaatccccttgtgtcctgtcgtctgagatctgtgtatcttcagcgtgcaggggaagcttcttgtagaagagataacatagtgcgccgcttggcacgggcgcactattcgccagcagacccagcaggcgtgccgcctgctggatgaccttgacgccgcctgccagcggatgggacgggacgtattaaatgctgagagggcacgtcgcccatcagcacagtggcaggcaacgcgtcctctcctcaattaatgcaggggctgcacgactttacgtcagggtcggcccgatggcttatgtcatgggccacaagcagcgggtctcctcctgagcgagaagtgaagggcaaggcctggacacgtgtcagcaccggacccctactcacgccagggtcctcctcattctgggaccttgctgaggttcgacccttactctgaggttctggacttatacgtatagggttccggtgtccttctgtggaggtccggaccccacgatacatactgggatgtgttgtcttttcttgctacgtggtgcccttcggcctgcccatgcagtggggtcaggcaccgtcctccgcgtggcctggagacgtcgcatgggtgcggcgtcttcatgctgtagaagagggtacccctgatttagggtaccgatagtggcccccaggcccgccttaggagaggatacgatcctgttggtggggccagagtcttattggtagttggcctgctgctcctgcgcgcctgttgatgcagttgctatcggcccgcctatggccacaccgacggccatgcccgttttcacggttgaccggcccgtgactcgcacttagcgcgcactgttgggccatgcgcggcgctgcctcctatcgtttggatggggcgtggctgtccgtccaccgcacgggcgacggtcgtgccgtgcgcaggtcggccacacccacggcttctcccgcgtcgacgcccgccccgggaggttgtacaagatgtcgtacgccgtgggggcggcggcggcgttcttggatggtcttgtcctcactcccgcagcgaggacgggagcgaggacctctttgcgcgcgctggggcggccaccgttcgccggtacggcactggtgcgcaggtggccgctgtcgtcggtgctgaggtggtcgccgccgctggtgaggctccccactgcagatgtggttgcctccgctggcgagaccgtcagtgccacccgccgccggacctctggctctttggctttaatggcctcgttgtcgcccccataggaagacgggggtgaggacctattcgcagtagcgctcaccctgaggtgatcgctgctgctcgcgagccgctcggagcggaggtcgttgtcgctgctggtgcataggcggtcactgtcgctggtgatccgtcgatgcagaggtggtcgccactgttggtggggctgtccggagccagcttccagcgcgactcctgctggtgcagcatagtccattcctgcagaaatggagctagggtcccgcttgtaagggaatgcaatgacatttgcttgagagcagaatgtaataacatatgtacgcaggattttagcctgggaagccaagttgtgtgttcggaccccctggatggtggcttcaagtactaagacacctaccgcagggcggtggagtatccaggctcacggtacgggaccaggctgagtggctacacggtttccggacccccccccaggagacaagtgttcgttcttcagagccggacctccaagttgttggacgcacaggactatagttttaaataataggacacccatcacggagtggcggagtgtgcaggattttgggtacggaaccaggctaaccggccacataggctccggaccaccctatggcacgggcatccgttctttagaaccggcccccaggccttcccctgtttttgtaaagtaataaatattgtctactaagcagtatttaacacttatctgtgtaccgcctgttcctgttgtgtatccccctggtacctgcccccccgcctcggatgcaggcttgatgtgacgaggttggataccagcgtgttctgaaagagttgtcaataattctcgggagggagcctctccgagacctaggtctgtacatagcttttagccaaggagcgttagtaatacacccgtaggacccgtcgtctgacactagccatcctttgatacatgctcgggacttgcagggtctagtctgggggagccaagttgtgcgtccaaactccctggatggtggttctaggtactaggacacccgccacagagtggcggagcatgcaggcccacggtacgggaccaggctgagcagctacacggctccgggccactccaggagacaagtgtctcttctctagttccggaccccaggttgtcggacccacatgacttatagttctaagtactagggtacccatcatggagcggtggagtgtgcaggctttcgggtacgggaccaggctaagcggccacacaggctccggaccaccccatggaacgggttcccattctttagaaccggcccccaggctgtcgggccctcctgctttcgcgaagaggtcctaacctgcaagcctggctgtccaatttggatgtcattatgtttgatggaacgagaactgcttgggtgggttaggtaaaataacatccataagactgcaaggtgagaccatggagcagtaggacaatcctatcatagaggcgcatctgagagggtagttttcctttataacttatcgtgcatgtgtgcggaccaacaggctgggtttatggggacagaccccaccgggttggcgtacatgtatgcgctacctagttacaaaagggaaacaactcgacccctcagacccgctttatagatagaacttacagagatgttccagcaccgggggaggtactcctttagtcgtagctagacagtcgccctcgggtcggagtattcccgttaccttgaagggtccttcccagctggggagtgttgtggagccctgacttggtttggtacttccgtaagattaggtcccgaccccgggtttccatctgcgtttgacgaaggagccctcgcccttggccttgatcattcctggataaacctgtcagaagtctggacccgtgggggacccagaatagtttccggaggaaggcaagcttcagctccgtaggccgagggacatggggtcccgctggtggttcgtctagacgccatcggagtgggagtctctagtgaagacgtcctttaggtccccctcgggtgactggtacccgaggtctcgctcagccacgactacctcgctgtcgtcaaccttttccttgccagggcgacgacgaggtggggagccgtccttggaagactgctcacgccactcgctgatgcgcttgctgacgcgtttcacgagatcaatgatatcgcggcactccgtggcgctgtggcgaccgttggggtgtacagggcacgagttgccgctacccctttgcggtcgtgggcatttgttgtggttgccccggcccccggtcgtagctgcaacgattagagcggtggatcgtggcttttggtagtcgcgatccttcttctttttcttcttctcgtcccggggggcggcactcgagccgcccggctgggcagccccgatttatggggccgagtgccatgcacggccctcggcggctctagcgcacttgtcagccagagcaaagagcgtggggacagtttccacgtcatgtgtggccaacttctccagcattttcttgtcacgtaccccctgtcagaaggtcgtgatgatggaggcatcagagatacaaggtattgtacctcgcaccttggtgaagcgtgagatgaacttccggagagtctctcttggctcctacctcaccgcatggaggtgggcctccacatcgtgttgttggtaagcgctggcgaagttcacgacgaaccgcacgtagagctcttcccaggtgtagatggatcctagggcgaggttcatgagccaagtccaggcaggtccagataaggcgacttgaaaatacgttgccatcacagcggtgtttccacctgctgccgtgatggcggtaacgtacacctgcaggaacttcgacgggtttgatgtcccatcgtattattctggtaggtgcagccggaacttgggcggccagatgccgcacgaagatggtccgcgagggcgttgcagcccacgtcggccaaggggacacccgtttgggaccgggtgcccattggtgtctgcggtgttgccgcagtaaagtcttgatcgaggttgtggccctcaatgttttggcggcgctcgcacgccctttcccgggagatccgagcgtcctctcccgtacgcctgtggttgagctctgcccagaggtcatcagtctgtgcacaccttacggaaggcgagcgcacagacgccgtggcttcgcgttggcgccgggatgaccagggcctggatctggtcaaggtagaatgagccataccgagtagccggtcaacgtcgtcacgccactgcttcatggctcctggtgaagccgtggagctagggggtggcgtagcaactccctggtggcagataatgtcgtaggtgtcgccctcgatggagtccgagacacttgcgcaagcgtgtgctgttgcacggcgtgtacagcagcagcctgaaagggaaatgtgcccttgggccatttctaagtgttttggtgatttagtgtccaacacaagtgactaagtgtcaattagtggacaaagtacaaatcaagtataaaggtatgtttctcagacttagtacattgttttagagactaatgtattatgtctaagtgctggaaacaggggaaatcaaattggaaaagagatggctttgttcagccaaagtctgcgcattctgggtgcaccggactgtgtggtggtgcaccggacagtgtccggtgcgccaggcagactcaggcgaacttgctgctctcgggaagtaattaacagcgtacggctaaaattcaccggactgtccggtgtgcaccggactgtccggtgagtcaacggtcggccgggccaacggtcggccgcgcgatccgcgcgggacacgtggccgagccaacggctagtagggggcaccggactgtccggtgtgcaccggacagtgtctggtgcgccaacggctccaaggctgccaacggtcggcttcgccaaataaggaaagagatccgcaccggacagtgtccggtggtgcaccggactgtccggtgcgccaggcgagagaagacaagaattgccttcccagattgctctcaacggctcctagctgccttggggctataaaagggacccctaggcgcatggaggaaaacaccaagcatccttgagcattgttgatcactcacactccattcttgcgcacttgttcgacattcttagtgatttgagctccgttctattgtgaaacttgtgatagtctcttgagctcaagtctgggttgtgtgtgtgcgtatttgctgtgatctttgtgtcttgtgtgagttgctcatccctcccttactctgtgcttctttgtgaacatcaaagtgtaagggcgagaggctccaagttgtggagattcctcgcaaacgggatatagaaaagaaaagcaaaacaccatggtattcaagtgggtctttggaccgcttgagaggggttgattgcaaccctcgtccgttgggacgccacaacatggaagtaggcaagtgttgtacttggccgaaccacgggataaaccactgtgtctatctgtgttgattctcttgtggttattgtgtttcgctaagactcttctctagccacttggcattactgtgctaacgcttaaccaagtttttgtggcattaagttcaagttttacaggatcacctattcacccccctctaggtgctctcaattggtatcggagccgttctcttcaggaaagggactaatcgcccgaagagatggatccaaagggaaaggggattgtgatcaatgataaggagaaggagtccttcgccaacgagccgaaagatgacaagcctaccgactcgggctcgggtcacaaacgaagagatgggaagaagaagacgaggcgcatcaaggagatcgtctactacgacgacagcgacgagtccacttcttcccaaaaggacaacgacgacaacgactacgacaaaagaaagacggttaattcaaacttttctttcgattactctcgtattccgcaaagtacaaatactcatttgctctccattccacttggcaaacctcctcactttgatggagaggactacgaattttggagtcacaaaatgcatagtcacttgttctctctccatccaagcatatgggagatagtagagagtggaatgaaatttgatagtactgatagtcccatgttcattaacgatcaaattcataaaaatgcacaagctactactgtgttgttagcctcattgtgtagggacgagtaccataaggtgagcggcttggacaatgccaagcaaatatgggacaccctcaagatctcacatgaggggaacgacgttaccatgctcaccaagatggaattagtggaaggcgaactcgggagattcgtgatgataagaggggaggagccaacccaaacatacaacaggctcaaaaccctcatcaacaagataaggagctatggaagcatgcgatggacggaccacgacgtcgtccgcctaatgctaaggtcctttaccgtccttgatccacatcttgtgaacaatattcgtgagaatcctaggtacacgaagatgacgcccgaggagatccttggaaagttcgtaagtgggcggatgatgatcaaggaggcaagatacgtggacgacgcgttgaacggtccaatccatgagcctcaacccattgctctcaaggcaacgaggagcaaggaggcgctacctagcaaggtagcacaagttgaggcggccgggctaaatgatgaagagatggccctcatcatcaagcgcttcaagatggcgcttaaggaacgcaaaggacagccttacaagaacaagacgaaggggaagcgctcatgcttcaaatgtggtaaggttggtcattttatcgctaactgtcctgataatgatagtgaccaggaacaagggaacaagagggaaaagaagaaagcttacaagaaggctaagggcgaggcacaccttggcaaggagtgggactcggattgttcgtcgtccgactccgacaacgaaggactcgccgccaccgccttcaacaaatcgaccctcttccccaacgagcgccataaatgcctcatggcaagggagaagaaggtatgtactcgaaatactacttatgcttcttcaagtgaggacgagtctagtgatgatgaaatagattattcatgtttattcaagggcctagatagaaccaaggtttataaaattaatgaattaattgatgccttgaatgataagaataagttattagaaaagcaagaggatttgttatatgaagaacatgataaatttgtagaggcacaaaaatctcatgctttagaagttaaaaggaatgagatgctttcttgtgaactatctacttaccatgagacaatttctagcttaaggagcataaatgataatttgaatgctacgttagaaatagctagtaaatcaacatcgtgtgtagaaaatgttgtannnnnnnnnnnnnnnnnnnnnnnnnnnnnnnnnnnnnnnntgctttcacgagggaagccattaacttgacaagccatatggcctccccccccactcaaggagaaagggaaggcccctatggcaaatagtgtgcaaaagaaccatgctttcttatacaatgataggaaatattctaggaatgttcaatgcaataattttttttcatatgctatgactgcttctagttcccatgttgtgcatgatagaaatttagcgaggagaaatgttattaatcacatgcctagaagaaatgttgttcataggaaaacaagtagtgaaccttttacaatttatcatgctttaaatgcttcctttgctatttgtagaaaggataggaagatagttgctagaaaattaggggcaaaatgcaagggagacaaaacttgcatttgggtccctaaggatatttgtactaaccttgtaggacccaacatgagttgggtacctaagacccaagcctaaatttgccttgcaggtttatgcattcgggggctctagctggattatcgacagcggatgcacaaaccacatgacaggggaaaagaagatgttctcttcctacgtcaagaacaagaatccccaagattcaataatattcggtgatgggaaccaaggcaaggtgaaagggttagggaagattgctatttcatccgagcactctatttctaatgtgtttttagttgagtctcttggatataatttgttatctattagtcaattatgcaatatgggatataattgtctattcactaatgtagatgtgtctgtctttagaagaagtgatggttaattagcttttaagggtgtattagacgacaaactttatttagttgattttgcaaaagaggaggccggttagatgcatgcttaattgctaagactagcatgggctggttgtggcattgccgcttagcacatgtggggatgaagaaccttcacaagcttctaaagggagaacacgtgataggtctaaccaatgttactttcgaaaaagatagaccttgtgcagcttgtcaagcaggtaaataagtgggaggagcgcatcatagcaagaatgtgatgaccacatcaagacctctggagctgctacatatggacctcttcggacccgtcgcctatctaagcataggaggaagtaagtatggactggttattgttgatgacttttcctgcttcacttgggtattctttttgcaggataaatctgaaacccaagggaccctcaagcgcttcctaaggagagctcaaaacgagtttgagctcaaagtgaagaagataaggagcgacaatgggtccgagttcaaaaatcttcaagtggaggagtaccttgaggaggaagggatcaagcacgagttctccgctccctacacaccacagcaaaatggtgtggtagagaggaagaacaggacgcttatagacatggcgaggacgatgcttggagagttcaagacccccgagcgcttttggtcggaagccgtgaacacggcttgccacgccatcaacagggtctaccttcatcgcctcctcaagaagacgtcgtatgagctactaaccggtaacaaaccaaatgtttcgtattttcgggtttttgggagtaaatgctacattctagtgaagaagggtaggaattccaaatttgctcccaaagccgtagaagggtttttgttaggttatgactcaaatacaaaggcatatagagtcttcaacaaatcatcgggtttggttgaagtctctagcgacgttgtatttgatgagactaatggctctccaagagagcaagttgttgattttgatgatgtagatgaagaagaagttccaacagccgcaatacacaccatggcaattggagatgtgcggccacaggaacaagatgaacaagatcaaccttcttcctcaacaatggtgcatcccccaacttaagatgatgaacaggaggcgtgtgatcaagggggagcacaagatgatcatgtaatggaggaagaagcgcaaccggctcctccaacccaagttcgagcgatgattcaaagggatcatcccgtcgaccagattttgggtgatattagcaagggagtaactactcgatctcgattagttaatttttgtgagcattactcttttgtctcttctatcgagccttttagggtagaagaggccttgctagatccggactgggtgttggccatgcaggaggagctcaataacttcaagaggaatgaagtttggacactggtgcctcgtcccaagcaaaatgttgtgggaaccaaatgggtgttccgcaacaaacaagacgagcacggggtggtgacaaggaacaaggctcgacttgtggcaaaaggttatgcccaagtcgcaggtttggactttgaggagacttttgctcctgtggctagactagagtccattcgtattctgctagcatatgccgctcaccattctttcaggttgttccaaatggatgtgaagagtgatttcctcaacgggccaatcaaggaggaggtgtacgtggagcaaccccctggcttcgaggatgaacggtaccccgaccacgtgtgtaagctctctaaggcgctctatggacttaagcaagctccaagagcatggtatgaatgccttagagactttttaattgctaatgctttcaaggttgggaaagccgatccaactcttttcactaagacttgcgatggtgatctgtttgtgtgccaaatttatgtcgatgacataatatttggttctactaaccaaaagtcttgtgaagagtttagcagggtgatgactcagaaattcgagatgtcgatgatgggcgagttaagctacttccttgggttccaagtgaagcaactcaaggatgggaccttcatctctcaaaccaagtacacgcaagacttgatcaagcggtttgggatgaaggacgccaagcccacaaagactccaatgggaaccgacggacacaccgacctcaacaaaggaggtaagtccgttgatcaaaaagcataccggtctatgatagggtctttactttatttatgtgctagtagaccgacattatgcttagcgtatgcatgtgtgctagatttcaatccgatcctaaggagtgtcacttagtggctgtaaagcgaattctgagatatttagtcgctacgccttgtttcgggatctggtatccaaaggggtctacctttgacttgattggatattcagactccgactatgctggatgtaaggtcgataggaagagtacttcggggacgtgccaattcttaggaaggtccctggtgtcatggagttctaagaaacaaacttccgttgccctatcaaccgctgaggccgagtacgttgccgcaggacagtgttgcgcgcaactactttggatgaggcaaaccctcagggactttggctacaatttgagcaaagtcccactcctatgtgataatgagagtgctatctgcatggcggataatcctgttgaacacagccgcacaaagcacatagacatccggcatcactttttgagagaccaccagcaaaagggagatatcaaagtgtttcatgttagctccgagaaccagctagccgatatctttaccaagcctttagatgagcagaccttttgcaagttgcgtagtgagctaaatgtcttagattcgcggaacttggattgatttatagcatacatgtgtttatgcctttgatcatgttccttatgcatctttgttgtttacttatggtgctcaagttgtacaagcactccccggaccttacaagtccatttgcaagtgaggcacaaatttagggggagatgtgctacaacttgaccctttgagactaactgtgtgcttgagtttgcttaatttagtctcaaaggtgggttgaaagggaaaaggtggacttggaccatgcaagacttccactacactctgatgaaagagtaactttttccaagttcatctttgtactcttattgcctttttagtcttagttgaagattttggtgaggcaatggggttgtagggccaagattgatcctgttttggtgcttgatgccaaagggggagaaaataaggccaaagcaataaatggatcagctaccacttgtgaaattttgaaaaagtagagttagagtttttgtttgtcaaaatactcttgtttgtctcttattgtcaaaagttggtctcttgtggggagaaggattaattatgggaaaaagggggagtttttgaaatctgtgatcaattctcttgaaacaactcttgttatgtctcaacaagtgtttttgacttagagataggaatttgaggttgatttgcaaaaacaaaccaagtggtgacaaagaatgatccatatatgccaaatttgattcaaaacaaatttgagttcttatttgaattgattttgtacttgttctacttgctttatgttgtgttggcataaatcaccaaaaagggggagattgaaagggaaatgtgcccttgggccatttctaagtgttttggtgatttagtgtccaacacaagtgactaagtgtcaattggtggacaaagtacaaatcaagtataaaggtatgtttcttagacttagtacattgttttagagactaatgtattatgtctaagtgctggaaacaggagaaatcaaattggaaaaagagatggctttgttcagccaaagtctgcgcattctgggtgcaccggacagtgtccggtgcgccaggcagactcaggcgaacttgctgctcttgggaagtaattaacggcgtacggctaaaattcaccggactgtccagtgtgcaccggactgtccggtgagtcaatggtcggccgggccaacggtcggccgcgcgatccgcgcgggacacgtggccgagccaacggctagtaggggcaccggacagtgtccggtgcgccaacggctccaaggctgccaacggtcggcttcgccaaataaggaaagagatccgcaccggacagtgtccggtggtgcaccggactgtccggtgcgccaggcgacagaaggcaagaattgccttcccagattgctctcaacggctcctagttgccttggggctataaaagggaccctaggcgcatggaggaaaacaccaagcatccttgagcattgctgatcactcacactccattcttgcgcacttgttcgacattcttagtgatttgagctccgttctattgtgaaacttgtgatagtctcttgagctcaagtctgggttgtgtgtgtgcgtatttgttgtgatctttgtgtcttgtgtgagttgctcatccctcccttactccgtgcttctttgtgaacatcaaagtgtaagggcgagaggctccaagttgtggagattcctcgtgaacgggatatagaaaagaaaagcaaaacactgtggtattcaagtgggtctttagaccgcttgagaggggttgattgcaaccctcgtccgttgggacgccacaacgtggacgtaggcaagtgttgtacttggccgaaccacgggataaaccactgtgtctatctgtgttgattctcttgtggttattgtgtttcactaagactcttctctagccacttggcattactgtgctaacgcttaaccaagtttttgtggcattaagttcaagttttacaggatcacctattcaccccccctctaggtgctctcacagccccagactcagggtggtcgggtactcgtggcgcagaggacgcaacttcttgctccatcgccaaatcttccgaagtttcggcgcggtgctcgatgattcgcaccatcatgctgagcgagggaacaagcaaaaacttcaagcatagacccctaactggcgcgccaaatgtctgagggtaaatctctctggccgggtggcggattgcacccgccctaattcctaaaatgaggaggggcctaagcgtcttgcttgttacgaggttggtggatgaacacacgagagcacacgagggtttagagtggttcggactgccggggcgtaacaccctactccactgtgtaatgtattgtgagtctgagcctgaggttggatctgtcttgtaatatcgcatgcctccccttttatagctgaaggggggcaggcacaaaggcactgagccccgacatgtgggcccagcgacatagagaacataacacttgggactataaatatttgctgccgaggcaatccccttgtgttctgtcgtccgagatttgtctatcttcggcgtgcaagagaagcttcttgtagaagggataacacagtgcgccgcttggcacgggcgcactgttcgccagcagacccagcaggcgcgccgcctgttggatgaccttaacgccgcctgccagcagatgggacgggacgcattaaatgctgagagggcacgtcgcccgtcagcgcagtggcaggcggcgcgtcctctccttaatgaatgcaggggctgcacggctttacgtcagggtcggcccgatggcttatgtcatgggccacaagtagcgggtttctgcctgagtgggaagtgaagggcaagacctggacacgtgtcagcaccggacccctactcaaactagggtcctcctcgttccgggaccttgctgaggttcggcccttactcagaggttctggacttatacgtataggggtccggtgtccttctgtggaggtccggaccccacgatacatactgggatgtgttgtcttttcttgctacgtggcgcccttcggcctgcccatgcggtggggtcaggcaccatcctccgcgtggcctagagacgtcgcatgggtgcggcgtcttcgtgctgtagaagagggtacccctgatttagggtatcggtactcctattatgactagcaattttcctattgtacatgaaagcatgattcttttgaacgctactagccataggggccttccctttctccttggcgagaatgggagccttttggcttgttaagttcttggcttcctttcgaaaaccaagcccatccttaattgaggggtgtctaccaatggtgtaggcatccctagcaaattttagcttatcaaaaccaattttgcaagtcttaagctaagtattaagacttgccacctcatcatttaatttggtaatagaagtaaggtgttcaacgcaagcatcaacatcaaaatccttacacctattacaaatggcaacatgttctacacatgaactagatttattggctacctatagcttagcatttaaatcattattcaaaatctttaaactagagattgattcatggcacacagacaattcagaggataacatttcatttcttttagtttctaaagcaagagacttttatacactaacaaatttgtcatgttcttcatataacatgtcctcttgcttctctagcaatctatctttttcatttagagcatcaattaactcattaattttatctacttttgctctatctaaactgaaagggaaatgtgcccttgggccatttctaagtattttggtgattaagtgtccaacacaaatggttatgtgttaaactatgccaaatggtggacaaagtgcaaatcaatacaaaggtatgattctagacttggtacattggtttttgtgtactaacatattggtctaagtgctagaatcagagaaaagacaaacggaaaagacttggctcgagcagccaagactctgctcagtctgggtggaccggactgtccggtggtgcaccggacagtgtccgatgcgccaggctggctctggtgaaaaggccactctcgggaattgaacggcaacgtacggctctaaatcaccggactgtccggtggtgcaccggactgtccggtgagccaacggtcggccgtgccaacggtcggccgcgcaatccgcgcgtgacgtgtggccgggccaacggtctgatgggggcaccgaactgtccggtgtgcaccggacagtgtccggtgcgccaacggctccaaatcatcaacggtcggctgcgccagaacaggaaagaaatctgtaccggacagtgtccggtggtgcaccggactgtccggtgcaccagtcgacaaaaggcaagatttgccttcctggattgctctcaacggctcctagctgccttgggactataaaagggacacctaggcgcatgaaggagaacaccaagcatactttgagcattcttgatcattcacacttcgtctttgcgcactcttttgacattcttagtgatttgagctccgttctagttagaactttgtgatattcatttgagctcaagtcttggctatgtgtgtgtgcgtattgctgtggacttgtgtgtgttgctcatcccatccttacttccgtgttcatctgtgatcatcttttgtaagtgttggacttggccgaaccacgggataaaccactgtgcctctctgtgttgatctttttgtggttattgtatttcgcaagaactcctctctagccacttggctttattgctctaacacttaatcaagtttgtggctttaagatttaagtttttacaggatcatctattcacccccctctaggtgctctcaattggtatcagaggcgttctcttcaagaaagggactaatcgcccgaagagatggatcctaagggaaaggggatggtggtcaacgacaatgagaaggggtccatcttcaacgagccaagggacaacaaagtcaatgactccggctcgagtcaaaagaagaaagacggaaagaagaagaggcgcatcaggaaggttgtctactacgacagcgacgaatcttcctcttctcaaaaggacgacgaatacgaggagaaaaagaaaacggttaactcgaacttttcttttgattattctcgtattccgcataattcaaatgctcatttgctttccattccacttggtaaacccccacactttgatggagaagactacggattttggagtcacaaaatgcgtagccacttgttttctcttcatccaagtatatgggagatagtagaaaatgggatgcaatttgatagttccaataactccatgtttatcaatgaacaaatccataaaaatgcacaagctactactgttcttttagcatccttgtgcagggaagagtacaataaggtgagcagcttggacaacgccaagcagatctgggacaccctcaagatctcgcatgaggggaacgacttcaccatgctcaccaagatggagttggtggaaggcgaactaggaacgttcgcaatgatcaggggagaggagccaactcaaacgtacaataggctcaagaccctagtcaacaagataagaagctatggaagcacgagatggacggaccacgacgtcgtccgactcatgctaaggtccttcactgtccttgatcctcatcttgtaaactctattcgtgggaatcctaggtacatcaagatgacgcccgaggaaatactcggaaagtttgtaagagggcgaatgatgatcaaggaggcgaggtacgttgatgaggcattgaatggcccaatctacgagcctcaaaccgttgctctcaaagcaacaagtaacagggagacgctacctagcaaggtggcgcaagttgaggcggtcgggctaaatgaagatgaaatggccctcatcatcaagcgcttcaagacggcgctcaaaggtcgcaaggagcaccccaacaagagcaagacgaaggggaagcgctcctgcttcaagtgtggtaagattggtcactttattgctaactgtcccgataatgataatgatagtgaccaggaacaagggaagagcagaaagtgggaaaagaagaagacctacaaaaaggcgaagggcgaggcacaccttggaaaggagtgggattcggattgctcctcgtccgactccgacaatgaaggactcgccgcctcagcccttcaacaaagtttggctctcttccccaacgagcatcacacatgcctcatggcaaaggagaagaaggtaaatactagaagtactattacatatgcttcttcaagtgatgatgagtctagtgatgatgaagtagactatgctagtttattcaaaggtttagatagaactaaaattgataagatcaatgaattaattgatgccttgaatgagaaaaatagattgttagaaaaacaagagaatcttttatatgaagagcatgattaatttgttagtgcacaaaattctcttgttctagaagttaaaagaaatgaaatgctttcatgtgaattatctacatgccatgaatctatttctaacttaaagagtattaatgatgacttgaaagctaagttagaagtagctaataaatctagctcatgcattgatcatgtagtaatttgtaataggtgtaaggattttaatgttgatgcttgtagtgaacacttaaattccatttccaaattaaatgatgaggtggctagtcttaatgcccaacttaagactaccaaaaatgaatttgataaactaaaatttgcaagggatgcctacactgttggtagacacccctcaattaaggatgggcttggctttaagagggaagccaagaactcaacaagtcataaggctcccatctccacaaaggagaaaggtaaggcccctatggctaatagtgttcaaaagaatcatgctttcatttatagtgatagaaaattctccagaaatgcttatatgaattgttcttatgattcaaatgccatgtttgcttcaagttcttcctttgtgcatggtagagatatgcctaggagaaatgttgttcatgtacctagaaaaccaagtaatgaaccttctacaatttatcatgcttgcaatgcttcttttgcaatttgtaggaagaataagaaagtgatagctaggaaattaggggcaaaatgcaagggagataaaacttgcatttgggtccctaagaccattgttactaaccttgtaggacccaacacaagttgggtacctaagacccaagcctaaatttgccttgcaggtttatgcatccgggggctcaagttggattatcgacagcggatgcacaaaccacatgacgggggagaagaagatgttcacctcctacgtcaagaacaaggattcccaagattcaatcatattcggtgatgggaaccaaggcaaggttaaaggactaggaaagattgctatttcatccgagcactctatttctaatgtgtttttagttgagtcgctcgggtataacatgttgtccgttagtcaactttgtaatatgggttataattgcttattcataaatgtagatgtgtctgtctttaaaagaagtgatggttcattagcttttaagggtgtactagacgacaaactttatttagttgattttgcaaaagaggaggtcggtctagatgcatgcttaattgctaagactagcatgggctggctgtggcatcgccgtttagcacatgtggggatgaagaaccttcacaaacttctaaagggagaacatgtgttaggtctaacaaatgtgactttcgaaaaagatagaccttgtgcagcttgtcaagcaggtaaacaagtgggaaatgctcatcacagcaagaacgtgatgactacatcaagacccctggagctgctgcatatggacctcttcggacccgtcgcctaccttagcatcaggggaagtaagtatggtttagtaattgttgatgatttttcccgcttcacttgggtattctttttgcagtataaaacagaaacccaagggaccctcaagcgcttcctaaggagagctcaaaatgagtttgagctcaaagtgaagaagataaggagcgacaacgggtccgagttcaagaaccttcaagtggagaagtaccttgaggaggaaggaatcaagcacgagttctccgctccctacacaccacagcaaaatggtgtggtagagaggaagaacaggacgctcattgacatggcaaggacgatgcttggagagttcaagacccccgagcgatttaggtcggaagccgtgaacacggcttgccacgccataaaccgggtctaccttcatcgcctcctcaagaagacgtcatatgagcttctaaccggtaacaaacccaatgtgtcatattttcgtgtttttgggagcaaatgttatattctagtgaagaaaggtagaaattctaagtttgctcccaaagctgtagaagggtttttgttaggttatgactcaaatacaaaggcgtatagggtcttcaacaaatcatcgggtttagttgaagtctctagcgacgttgtatttgatgagactaatggctctccaagagagcaagttgttgatcttaatgatgtagatgaagaagacgttccaacgaccgcaatacacgccatggcaattggagatgtgtggccacaggaacaaaaggagcaagatcaaccttcttcctcaacaatggtgcaacccccaacttaagacgatgaacaggttcatcaagaagaggcgtgtgatcaagggggagcacaagatgattatgttatggaggaagaagcacctcaagcacctccaacccaagtccgagcgacgattcaacggaatcatcctgtcgaccaaattctgggtgatattagcaagggagtaaccactcgctctagattagttaatttttgtgagcattactcctttgtctcttctattgagcctttcagggtagaagaggctttgctagatccggactgggtgttggccatgcaggaggagctcaataatttcaagagaaatgaagtttggacactggtgccacgtcccaagcaaaacattgtgggaaccaaatgggtgttctgcaacaaacaggacgagcacggggtggtgacaaggaacaaggcacgacttgtggcaaaaggttatgcccaagtcgcaggtttggactttgaggagacttttgctcctgtggctaggctagagtcaattcacatattgttagcctatgccgctcaccattctttcaggttgttccaaatggatgtgaagagcgctttcctcaacgggccaatcaaggaggaggtgtacgtagagcaaccccctggctttgaggatgaacggtaccccgaccacatgtgtaagctctctaaggcgctctatggacttaagcaagccccaagagcatggtatgagtgccttagagactttttaattgctaatgctttcaaggttgggaaagctgatccaactttattcactaagacttgtaatggtgacttatttgtgtgccaaatttatgtcgatatgacataatatttggttctactaaccaaaagtcttgtgaagagtttagcagggtgatgactcaaaagtttgaaatgtcgatgatgggcgagctaaactacttccttgggttccaagtgaagcaactcaaggacggcactttcatctcccaaacgaagtacacgcaagacttgatcaagcggtttgggatgaaggatgccaagcccgcaaagactccaatgggaactgacggacacgtcgacctcaacaaaggaggtaagtccattgatcaaaaagcatatcggtctatgataggttccttgctttacttatgtgctagtagaccggatattatgcttagtgtctgcatgtgtgctagatttcaatccgatccaagagagtgtcacttagtggccgtgaagcgaattcttagatatttagtcgctacgccttgcttcgggatctggtatccaaaggggtctacctttgacttgattggatattcagactccgattatgctagatgcaaggtcgataggaagagtacatcagggacgtgccaattcttaggaaggtccctggtgtcttggagttctaagaaacaaacttctgttgccctatccaccgctgaggccgagtatgttgtcgcacgacagtgttgcgtgcaactactttggatgaagcacaccctccgcgactttggctacaatctgagcaaagtcccactcctatgtgataatgagagtgctatccgcatggcggataatcctgttgaacacagccgcacaaagcacatagacatccggcatcacttcttgagagaccaccagcaaaagggagatatcgaagtgttttatgttagcaccaagaaccagctagccgatatctttaccaagcctctagatgagaagacattttgcaggctgcgtagtaagctaaatgtcttagactcgcggaacttggattaatttataacatacatgtgttttatgcctttgatcatgttcctttatgcattttgttgcttaattgtggtgatcaagttgtacaacgcaatccccggatctcaaaagtccatgtgtgagtgatgcacatatttagagggagatgtgctacaacttgatcctttgagactaaccatgtgggaaaggtggacttggaccatgaaagacttccactgcactccgatgagagggtaacttactccaagttcatctccttattcttattgcattttactcttatttgaagattttggtgaggcaatggggtttaagggccaagattgatcccgttttggtgtttgatgccaaagggggagaaaataaggccaaagcaagaaatggatcagctaccacttgagaattctgaaaatagtagagttagagtttttgttttgtcaaaatcatcttaatgtctcttcttgtcaaaagttggtctcttgtggggagattgtttgattatgggaaaaatggggagtttttgaatctttgatcaatttctcttggaatacctttctctatgcctcgacaagtgaatttgacttagagataggaatttgagtttgatttgcaaaaacaaaccaagcggtggcaaagaatgatccaaatatgccaaatttgaatcaaaacaaattcttgttctcatttgcattgatgttgcacttctatatgttgctttttgttgtgttggcataaatcactaaaaagggggagattgaaagggaaatgtgcccttgggccatttctaagtattttggtgattaagtgtccaacacaaatggttatgtgttaaactatgccaaatggtggacaaagtgcaaatcaatacaaaggtatgattctagacttagtacattggttttgtgtactaacatattggtctaagtgctagaatcagagaaaagacaaatggaaaagacttggctcgagcagctaagactctgctcagtctgggtgcaccggactgtccggtggtgcaccgaacagtgtccggtgcgctaggctggctctggtgaaaaggccactctcgggaattgaacggcggcgtacggctataaatcaccggactgtccggtggtgcaccggactgtccggtgagccaacggtcggccgtgccaacagtcggccgcgcaattcgcgcgtgacgcatggccgggccaatggtctgatgggggcaccggactgtccggtgtgcaccggacagtgtccggtgcgccaacggctccaaatcatcaacggtcggctgcgccagaacaggaaagaaatctgcaccggacagtgtccggtggtgcaccggactgtccggtgcaccagtcgacagaaggcaagatttgccttcctggattgctctcaacggctcctagcttccttgggactataaaagggacccctaggcgcatgaaggagaacaccaagcatactttgagcattcttgatcattcacacttcgtctttgtgcactcttttgacattcttagtgatttgagctccgttctagtgagaatttagtgatattcatttgagctcaagtcttggttgtgtgtgtgtgcgtattgctgtggacttgtgtgtgttgctcatcccatccttacttccgtgttcatttgtgatcatcttttgtaagggcgagagactccaagttgtggagattcctcgcaaacgggatatagtgaaaggaagagaaacactatggtatttaagtgggtctttggaccacttgaaaggggttgagtgcaaccctcgtccgttgggacgccacaacgtggagtaggcaagtgttggacttggccgaaccacgggataaaccactgtgcctctctgtcactactacataacatagctttagtaacaccaacttgtgttactatatttcaataaaggtgttactagctgtactagtaacacatcttgtttgtgttactatatccaatgttactagtatctaacctattggaacacaaaatatatgttccttttttataaaaaaagtgttactactctgtaacacaattacttgtttattggaacatttattagtgttacaatatttctctagcgtaacaatttttttagctatagtaacactttttcattacaatagtaacactttgtgacaacatacattggaattttaggtacatgttgtttgtaacacatgctttacctattgtaacactttcaaatttcaaatgaaaacgctatttttaaattgcacatagcacataacattgacatgaatttattaagggatcatgacacatttgcacaacaacaaaaatcacaacttcgagtaatcacttgcattgattggaggaaggtaaaaacatagtacttgttcacaaaatacaattatatatttacacaatgatatgattctagggaataaatgtagcaagtggtagatagtacaagtctgtaaaggtggaaatgaaatgtaactacaaataagaaatattcttggaattcatgtttcttggtcatgtctcatgcgcatccaaatctacaaattcatccattgatcatttgaacctgcaaagagaatggtcgttgtatcgttaatcatttcagcctactacctagagaaagcaatttgtaacattacatatttataaaacttgttgtagcatacacaaagccaaggccaagcaattgctactccttttgcatgggcatcaccaattttgtcgtagccaggcatgggcctaaccaaaggctcatcttgtaaaacaggatggttgattcggactttgtagaattgttttcctatctcaactccaccaacactttcttttggactagagctcagaatggttgcataggccacaattgccttatttggacggcttgctgtcttaagtatcactgtggttccatcctacattgaattcacagagtcatcaacaagcactagtttattgtatagtaacaagcataatttgtgttaaagtaatgcaactatatcaattgaggttatatttgctcaccttaattggacgaggttgtgtaaattttgaattattatggcccatagctttatcctgagcaattttctgtgccatgatccggttctctttgagtactccttgtttatatgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttgcacatttaagactaaaaattgaatcattgcagtcatttagctcattggtcaaaattttattcttctctttctcatgagttagggccttttcaagtttctcatttttctttgtctcatcaacgagcatagcttcttgcttctctaagagttcatccttctaattatcgaccttaatcaattcattcactgtagcaatttgatgtctactaaggcccttgaaaaatatagtaatctctttctaaccactgtaaccatcatcatcactagagaaagtatatttagaagatgttcttgtggataccttcttcttactcttatttgccatgaagcatgtgtggtcgaccttcgagaagagagagcttttgttgaaggcgagggtggtgacgccttcatcatcgaactcgaaggagctctcatccgaatcccactccttgtcgatgtgggctccgcctccttcttcttgaagaatttcttcttcccattctcctcttttatgtcatcattatattttgcatatggacaattagcaataaactagttggtcttaccacattcgaagcaagccctcttaccacagggcttgtagcccttgctatttcggttccttaggatttactggaagctcttgataatgagggccatatcctcatcgtcaagccccaaaacatcaatggtttccttctacttgggccctcctcgtttgttggcttcaaggaaacaatttgtggctcaatggaggtgatgtttccttgcgccaagtcgtcgatgagcttggagtccttaaccatcatcgcgtggattaggaacttcccaagcacatcttcgagcgacatcttcttgtacctagaattctcacaaaataaggttacaagagtagcattacgaaacgtaaaggaccttagcatgagcttgatgacttcatgacccgtccacttattgcttccgaggttgcgcacttggttcaccaagttcttgagccggttgtagatctcttgtagcccttctctcttgatcatggcgaactgaccgagctccccttctaggaactccatcttggtgaccttggtgatcttatcaccttcatgcgccgtattgtgtgggtatcccatattttcttggcgctctccaacccgtccatcttgttgtactgcttacacaaagaagcaagaagtactacgatggtttacgagttacgatggacaatttgttccacctccactgggttgtaccccttgtcgtcgtcatcgggtatctacattcctaattcaacaacatcccaaaaaattggtaggttttagaactccaccaacaataatctgcaccatcatagtgtggtgtttttttccaagtggaacagaaagtaaagggatagttgtattgcgaggaatgcgagagcaattgaaagacatctaaagctttattcttccctatatcatggagcacctttagagcatctccaacaaataccttaaatcagtactctaccttgaaatgtagggtcgaacccataaaaacggcacaaactgtgctgcattttacaaacttttatcaaaaaagatacatgacacactatgaagtgacccaaataatatactactccatagtacagtccaatccctttattctatatcattctcaatattttctttcataataaataatttacatcctataatatatgattttgggtttaacgttagaattcgattagggattttgtaatattttaaatgatgcaatattttaaattacaggacacttttttgaggtattttgttggagatgctcaccgtacacaccattggccgaccagttatccgaaaaggaagaaaagctagaaaacactcttggatggacggtatcgtgattccctttgtctccgcatacagaacgtaacgcgacggtcgtgctaactgacactatatatcgagtagctagcgaggtcgatgtgcctggcagtcgtgtgcacctacagaacctggcacgtacgtaatcactgaactgctcggaagtcggaatgcaggcgaagcgactaggactagctagcgagggcgctggcacgtacggtgacggtacggtagcagcggctgctagtcatcggccggccacctgcgctcctgaaacggcggcacaaccggccacctgattctgatctgccgagccacgtccaccgcacgacgaatccgccgcccgccccgccctcaccgtcacgggccggctgtgcccacctaccgacgctcgcggttcgtccgacgccctcagcaacccgcactggtcggttggtttccctggggacgatgtccacccaccgcggtcccctcgggtcaaccgcgcgcgcagagcgctgctattccctgcccggcgcggcggcgcccccatttccccgcgcgccagctagctcaagagtagggctgaaaaaaaagctcgagccttgcgagccggctcgggctcgatcaggctcggctcggtgaggctcgtgagcctaaacgagcccgagccgagcctaattccatggctcgctacactaacgagccgagccgagccggctcgaggctcggtccaaactacttcttacttgtatctccgttgaccaatgtgtaagtgtgctgttttagtcacaactcacaaggaactagagtgcagggacataaatttttattatatggaacatattatgctttaaatttgagttaattactatatttactgttgttgagtacttgagtgtacaggctcgcgagccgaaccgagccggctcgcgagcctatatcgagccgagccgagcctcgttaccgagctcgctaagtgatcgaaccgagcctggctctgctcgctattccaccgagcctcaccgaaccaagcctggctcggctcgtttccagccctacccaagagcgcagcagcgcgtataaataaacggcgcgctcctagtcctccacctcccgctcactccgagtctcactctcactccgtcctccctcttccttacagaaacacaactcatgcagctcgtacggcaccaccaccaccaccaccaccaactgccgcactgacacatgcatgcgcagaaagcagctagctagcggccggtggccttgagagccgctcgctagcttttaaaattagccaccaattcaatctctagctagcttgggggagctccgttcctagctacacgtacgggcggcgcggcaacaccaccagccgtgtagccgacctagtacgttggagcgaagcatatatcggcggccgtatcacatggagagcgcgatggagaaggtgtgggagtcggggcggcggatgagccggagcatcgggcggggcatgggcatgggcatggagacgtggggcgtcgacgacgccttcgtgccgcagcacggctcccggtcccgcggcggcggcggcggcggcggcgacgacgacgaggaggcgctgcgctgggcggccatcgagcgcctgcccacctacagccgcgtgcgcaccgccatcctgtccacggaggccgccgccggggttgacgacgacgacgacaagccgcggcggccgccgccgcagcagcagcagttcaaggaggtggacgtgaggaagctcggcgtcggcgagcgccaggagttcatcgagcgcgtcttccgcgtcgccgaggaggacaaccagcggttcctccagaagctccgcaaccgcatcgacaggtgcgtacggacggacgcacgcatatgcaaccaccctcgacctcgacgtcgtctatctatctagacatatttgccgtgctgtcgtttcctgttgcctagctactactccaccatgtggacaccacgcatgcatccacagtagagttggcacgtacttttcgtaatcactccgccgtactagtacgagatacatggggctacttcgaattaaacccgtctacttagacttgctgcaattataattttatagaaaaaaatattgtataaatagtagaagccgatatggatgaaaactaaacgaacatgctatgggtttacagcaagccgctgcatatagcttattacttgtttgctgcgcaggctgtcaataagacaagaggatatttggaactgttcagtttcagcggagctatacccgtagtatataataaataaataaataatataaagatttataacttcagctctatgattttctatagcatccattccactgttttttagggcgtaaacaattctaaatagaacctaatttgaacggtcacctacacaatatttagagctagcttggaaacttaaatcttcttcgaggttattctcaagtaataatgagtgaaaaatgagttaataacttaatcactggaaatctcaaagggatttaagtttccaaattagtgtttaactaaataagattttccccttcgccaccccggtcaacaccacacccccctccctccaacctctttggctttggctgcctagattgtggtttctccttccctatcatatggagtaatacaaccttctagaacatgaacatcattacagagtacccaccatgatttgatcgattgattgattgggaccggtgtcaccagaagggcagatatacgtcccttgctcggtcgggaagcaaatggctcgtgccgtcatgcgtcaacaagacctgtgagccatggtaccgagaaaaccatctgtggtgcgcgggtcctggttaattaatgaggtcatcccacgtctgcatgacgagaggtctttcgcggattaactatttgatcatcaagtgtcttatgtttccaataacctaagctacctagctaggatcatcagcgcaatatatagctgtcatagtactcctatatttacaggagtactgccgattttatatcttttgaggacaaagtaacatgccattttgtttgcagtcagttctcagttaagtctacgtgtaaataatttgaaaaaagaaagaaaaaaaaaccaacaccaacaccgccaatgcaaatgcagggtgggcatcgagctgccgacggtggaggtgcggttcgagcggctgacggtggaggccaggtgccacgtgggcagccgcgcgctgccgacgctgctgaacacggcgcgcaacgtcgcggaggcggcgctgggcctgtgcggcgtgcggctggggggccggcaggccaggctgaccatcctcagggacgtgtccggcgccgtccgcccgtccaggatgacgctgctgctgggcccgccgtcgtccgggaagaccacgctgctgctggccctcgcgggcaagctggacccggcgctggtcgtcgccggcgtcggcggcggcgaggtctcctacaacgggttccgcctcggcgagttcgtgccgcagaagacggcggcgtacatcagccagacggacgtgcacgtcggcgagatgacggtcaaggagacgctcgacttctccgcccggtgccagggcgtcggcgccaaatacggtacgccggcggccttattgtgtttttttgatttggcgtacggacgacgggcacgatgggctggatgcgttttttttgacggtggatgcgtgtcgtgtcgaccatcagatcttatgacggagctggccaggagggagaagggggccggcatccggccggagcctgaagtcgacctcttcatgaaggtagagtagagaaagctagcatccacaattccacatgaataaaaagtactagcactctagttgctgcatttagtctgacgatcaaagtgcaccacgcgtgatagtgcctgtccttcgaattcggagtctacatgcgcacacatgtatatatgcactcattagtaattatcatagaatatacccatcattagtatttttttactgttgccaggcgacttcaatggaaggagtggagaacagcctccagacggattacactctcagggtataacagtcctacggctttacaaattatatctcgcgtcactttgcttttttttttctttagcttccattttgatgatttggcgttaccgcgcgcgcgggtggattgaggattgagcgcttttgcttcagactagagtacgcacacaagattagttcaggctcagcctgagacgggataacttgagtacgtaacgtactacacagtttgtggcagtgggtcagtggggctggtttggccactcactcactcactcctgctactacccgactcatctgaccgtacacccaactacccaagcaatcttcttcacctagctgcctgccgcttgcctgtgcccggtggggtcttgctgcagccaaccccggacgcagaaggttggtgcaacaacctgacctgaggccgatggcggcgccatcgcgcgacaggatcgtcagccccacctttgcgcacgcccacgacgtgttcgtcgagatgccaagccgaaggtttccgctcttttctctagcttggctctgtcactttggccacagttcgcacggtcggggaggatggacgtttggtggagtctggcagtagagggggatttccgcgggcgagcagtcgctctctcctgatgttaacggagagagtagtttgacggtggtgtagttgtctttgtcttgactgcgatggtcgacgggtgtgtgggatgtctgactctctgacaggcgttggtctgtgtggtgtgcagatactggggctggacatctgcgccgacaccatcgtcggcgaccagatgcagcgggggatctctggcggccagaagaagcgcgtcaccacaggtaaacttgcttccgatccattccctcagcaccatgtcatgcccacggcaggctgacgtcgagaggtgaaaggtggagacctgatatgattgctgcaatcatgtgacgtttgaaattcagctaacgacacagtcgagtgtcacatcctgcggttcgtgcagaaaaaaaaggaactgtgcttttgtgctgtgcctctgaggtccacacacacaagggacaccgtgcctttgattgggacgcagcagttggtagcgtaccatctcgtggttcagggattccagggtaggttgttggttggtcacttgtccacacagtgaccactgctttttctcttcaagagtgcatcgaacgtagtatactagaaaatccggtttcctgttcacttgtccaaacacaatagagttccttttttttttccaaacaaggcaggagggttgcattgtcatctcattaagaaataagacaaaatacagatggagatgctgtaacagcctccccacctctgccaaataagtacatcaaacagggttaacaaactcggtagacaaaacaaaggagtttctaagcctactgtggtctatcctgtagaaaccaccgtattgtaggttaaatgagtgaatcttgattgatagttccaaattgattaatagtgcaggggacaaaatgtaactcttgcactagctgtatggaactcgggttacataaaatgctaacgatggttagcgagatagctacacttgttttgccagtggaaagcattgataagtggcaaatttctttgtaacttaacacttaacagtgcagccacactttgtgagatgcgacccaatgctcagttcagcgagagatgtagcaatgcacaagcaccatttcaaaccggtttatatatgaatccgcacggttttctgaacattttcagggtgcatgatgtttgagatacctgtgcttatcttggaacgcaggggagatgatcgttggcccgaccaaggtgctgttcatggacgagatatcaactgggctggacagctccacgacgttccagatcgtcaaatgtctccagcagattgtgcacctgggcgaggccaccatcctcatgtccctcctccagccagcccccgagaccttcgacctgttcgatgacatcatcctgctgtcggaaggccagatcgtttaccagggacctcgtgaatacgtcctcgagttcttcgactcctgcgggttctgctgccccgagcgcaagggcactgcggacttccttcaggaggtaccattcggcacttgtctagtaaagtagtaaccatatattctctgaaagcaaagtttatgaattgcaacaagacgaccgattctttgggtgcctttccaggtaacatcaaggaaggaccaggagcagtactgggcggacaagcagatgccttacagatacgtttcggtgccagaatttgcgcagcggtttaaacggttccatgtcgggctccagcttgagaaccacctctcgctgccgtttgacaagagcaggtgccatcaggctgccctcgtattctcgaagcactcggtgtcgacaaccgaactcctcaaggcatcctttgacaaggagtggctcctcatcaagcgcaattcatttgtgtacatcttcaagaccatacaggtaaaacacattgtttttgggagtctctcccatgaaactttccaagactcccagtgctaattgactgaccttattgttgtctgtcctgtgaactctgaagcttatcattgtagccctcatcgcgtcaacggtgtttctgagaactcacatgcatacgacgaatctagatgatggctttgtctacattggagcactgctctttactctgattgtgaatatgttcaatggttttgctgagctttccttgaccataacaaggttgccggttttctacaagcaccgggacctgctcttctatcctgcttgggtcttcacagtaccgaacgtcattctcagaatcccattctccattattgaatctatagtatgggttcttgtgacatattacaccatagggtttgctccagatgctgacaggtaaatgaaggagtagtccttttttctaaaacatttctggaatcagaattctgtaatggctaattgtattatgtatatgggcaggtttttcaagcacttgctgctcgtgttcttgatccagcaaatggcaggtgggcttttcagagcaacagctggactttgcaggtccatgatcattgctcaaactggtggagcactatttcttcttatcttctttgttcttggaggctttgtcctgcctaaaggttcattgcttgtcttcttccttttttattcacacagatcaatattttctttgctgactagttctttgccgtcccactgttaacagttttcattcctaactggtggatctggggctactggatctcacccttgatgtatggatacaatgctctagctgttaa

SEQ ID NO: 117 - DNA, 11915 bp, Zea mays
  promoter (1824)...(4823): ZmS24
  misc_feature (4824)...(5994): ZmS24 CDS (exon and intron sequences)
  3'UTR (5995)...(6160): ZmS24
  promoter (6161)...(6888): ZmAAP1
  misc_feature (6889)...(8556): ZmAAP1 CDS (exon and intron sequences)
  3'UTR (8557)...(8822): ZmAAP1
  misc_feature (1)...(11915): Genomic fragment
gctgacatagcgaccgtggcctttttctagatgatgacgacagccttaaacataaagctaggatttatttatgactaaattctcatatgccttatggttgaagataaaaacaactatgaaggttgtattttctattgacatttcatattattggcctctgaatgttttttccgtccaagataaattataaatgactgggttaccaagtaatatcggaacacagcaggggtattgaatctctacgtacgaaaatcatacctgtagctaggcctgacgaacatttttttaagaagttgttgctcatatatctcaccgctacataaaaacactgaagactagtttgggtactctagtattgggttcaatctatatgtattgaggtggattagagtatactttaaactaatttacactcaaatccaactcaacacatgtggattaccaaacaatcggtgaccgtaccgcctgaccgggtcagtcgtcatgacacgagaggtaattaaaaactcgcgttaaccacgcaacacaaaagtaaaacactactgaagcaagcaacgtaccctccaaccaacgtacagttgacgaaacgtcgtccatgcccctaatatatagccatatattataagaagattagctaaggagagaagagaagaagaaaaacacgattgtggaggaaatgatttctgcttctgcatcaggtgtcgtacgttgtacaggatctatatatagctagattattcatgacattatttaaattgttcgtcgttttctcgcaagtcgtcgcaaggttaaaagagacatacatgcatgtcgatcggaccaactcgacgccctttgaaccggagccgatcgtatcaggtacgtacaggtacaacgagagctggcatgtcaaattcaaaaactctagcagccaatgcaagtaaagaagagatgcaatgcaaacaaaaggcttttaacagcaacgacgacaagccaacgaaatggatcgttttcaagcgccatagaatcgaatcggccacgccacacgaacaccacacgaacacacgatcgctgacgaactcgagcacaatcacagcatgccgcggttggtggcgctggcgcgcgatcatgcataccatcattggcggcgttatttcgcatattcacgcgtacacaactgctgcaccacgcactgacgacgtacgcagccgaagacgttttcagcctctcgcatcgatcaccatcggctcagtcgacgcaagtgccgtgccggatgtcattgtagctgcgcgtaagaccgactcatcatcgcgagaggggttatttgaagtgcttcatccattcttttttatttgtcactgtttagtaaaaaaataaactagtcaataaatattcaagaacagagatagtataatctaatgacgtatgcactataaaacattcgagagaatgataaatacatatgtacagaaatctagaataaaatagacaattatgtatacaaaacaaaatatagataataatgttggagaggtacgaggtatatatagaggagaaatttttttagagaaacagaagaggggaggatatatatggatcgaggagactcttggagtcagtataagactgtctccagcaacgtcctctatatacatcctctatatccgtcttttacagtcttctctaaaatattccatctcttatatctactttctctccaacaacgtcctctaaatcacgtcatctatatgtaaatacctatattaaagacatttttaattttttaatttttgtacatacgtatttgtcatactctcaaatgtattgtacatattttagttttattaaaccggttgtttaaagtattcaaatagatagagaaccgtttagagaaactctacatatagaggatccagcagcgttatctaaatttagagaaccgtttagaggacgttgctggagggagtagaggacgtcctcgtcctctaaatttagggtacagaaccctttagagggtcttgttggagccagcctaatcccaccaagtcattgtcaaggtatacgtacgtacgcgagtgatctctcgtcgtcccatgtacgtatgtatgaccggtcgtagtagttcgcatttgctgcaagtggccgtatatagtcggtcgatcgagatgaaaaagacacacggcaaggagatccttggcgacctaccacgcaggtgacgcagtggacttgcggagttgagagtctccagagttgttgttgcttgtgcatatgtacaagcgcgctgtgtcaaatgcacgcatgattactggtggcgcttacctcaggtggccgtggcactgcctgacgttgcgcgtggaaaaaaacggtaactatgctagtgtttgatttagagtacagtgaaatgaaaccgctccgtttttaatttatttttgtttagattatttatagagtggtttaaaaaaaggaaaattagacttaaatgatgaaccatctggttcttcaaaatcttttaaacggaaccagtttttaggatagagccattctatcccagctgactctggaaccaaaacactatctaagaccgtgtagcgaagctatatatgtgtaccggtggtcagaaagtgtttgtttccatacacaaaggacctgtgaaaatcgtaacttcgttgacgtcttctaaagatacgtcaatgtaataaatatatttacaccattgattttattaagacaacagccaacacaaacctatttacaccgatggcggccgtgtcaataaaactgccgaagtaggtgggtacagatcgaagaaagctgcatgtgtaaatagatttacaccagtgatttatctaaaggcagacgcctctaaaaatggattctcagagacggtttaatagcatatatgaacctattctaaaattttcaagataatttcaccatactactactcaaccttatccaatcctaatcaacaatatataacaacgtattgaaatatacatcacatacaatcatattttcatacgtgacaaaaacaatattaacttaactcaatcatagccatcaatccaagtattaatttacgtcaaccatatatatagaacacatttttttattcccggcgtgtcaataatatatagggtatccagatcaaacttaacaacaaggcatgtacgaataggcccatgagctcagccacgagagtccacggactcggtcctcatgatcagaaggaagtctaccgctaggaaaatctaggagcattaatatggcaaagatctatccgaatatggattcaagatcctaacggagacaaatatcctaaggtcttgttcgtttctatcggattggtgggtcggaacgaatcctaaccggattacttctctaatttatataaactttgattaggtggaatggttccgggtgcaatccgacacaaacgaacaaggcctaagaccttgttcgtttctgtcggattggtgggtcggaacgatttctaaccggattgcttctctaatttatataaactttgattagctggaacgatttcgggtataatccgacacaaacgaacaaggcctaatggataaggcaaaaatcctagtggataaagaagacacactttgtaattatagctagagtcggattcatatataactagataactgaattgatactgtcatggactaggtaaccaactcggtatctattatataattgtcccctttttagactataaaatgaggagcgaggaagcccttaggagaagatcacatctcacataacaacatttcgatggcggggcacttgagccggagtgccgaactgctggaggatactagggcacacacgccttgtcgactccatgcaccggccactgaacttgcttgtataatttttttgacatcgacgaatatagcctatgtcgaagacaaaacaatttatttcaactaaaagtacttacccatgcatctgaaccttaaattcatttctgaagcggctctacggtaaattctctttttaaagttacagtacctgagagcatctgcaatagatcctaatatcatcatctcaatccagattttaggggaaaaaaagaaaacaaaaacaatcatccaatagtaccttcgccatgaattttggattgcgttgggtgtcactgtcagtgacgacatctgctgctccaacttgcataggaataggataccttgccccctgcctacatcaggacgcctccctatggaagcgacgcacaaactacatattacgtagagagtcttcgacgttagctatcatcctccgtttatgtctcgcagatgcccgcatgtgggcataccatctgaaaaacaatgactccgttcaagagactgcttggtgtggttgcctctctcatgccctctcgtacctgtaatttctctaccccttggagtagtttttttctggccgttaaggctaatatatcggatgagcgttttctacccacatagaatttttttaaaaaaagttggagttgctgtaatgccgaggtactagagcctagaggcgtccctgaagcttttggattcaaagttgaaacacgcttttttagaactgggccttaaataaggttggcattgactattcggcccaaatccataaaacgatgaagtctgggcgttttcaaatcagattcagcccacaaggccataacaaaatagccccgccccccctcccctagggtttcactacatatgtaaccctctcgcgcaaacactcctctttccgcgccgcctcccctcccgccctcttgctccgccggcgcggccaccgccaccgccaccgcaacagctagtcagcagatcgtaaccatggcggattcgaaggccgctgcggcggtgacgctccgcacacgcaagttcatgaccaaccgtcttctctcccgcaagcagttcgtgctcgaggtcatccaccccggccgccccaacgtctccaaggttgtgggtctcgtcctctcctagttcctcggttccgtgccctccgtgatggccgtcgcggtcttgacggtatttcattgttcgcgcaggcggagctcaaggagaggctggcgaagatctacgaggtgaaggacccaaactgcatcttcgtgttcaagttccgaaccaacttcggaggcggcaagtccaccggcttcggtctcatctacgacaaccttgaggccgccaagaagttcgagcccaagtaccgcctcatcagggtatatcattgttgccttgcgacgtcagagtgtagtttagtttcgctcttgacctcgctgtttacgggtactgatgtagtaatgcgcggttgatttggatatagcgttcgttgacttctagctgtgattctttagtggatatacatgtgcattaacgctctgattcttacattctagacaccattaagtaatgtttattttttttatcaaacacacatcctaaaggtgctacaagcctaaaactgccaagggagcttttagcgtacttggttgagtgctcaataattatcctaacatgtagctgtgtctcaataaaaatgattctaatctgggctttgatgccaaatcatatatatgtcactcaagttgatgctacgtcagacgcattatttttggataataagcttgttttaatagcagattctcgatgatctttttcatgtggcagatttactgcacatgttgtaattaagctcgttagtttttgactgtcttgagccttcagatgacgccattcactgtttgctgttagcctctgtttgatacacctgtccgtaggtgctaatgttctgtttttcgtcgacagaacggccttgctaccaaggtagagaagtcacgaaagcagatgaaggaacgtaagaacagggcgaagaaaatccgtggtgtgaagaaggtgagtaccagtcaggaattgctactcgtattcccattgttctggtacatttcaattatgtttgctgcacaattttttgcagacaaaggctggagatgccaagaagaagtaagggaggaagttacttgccttgctctttctctcatcataggctttggtttgtttagggtggggctccttccggcaatgctgaatgtttagttagaagtagagaagattttgccaattacccatcatgttgagtttctcgtcgcaccttctgttcagttttgaggcactttgtcagacacaagaatatatatatacctggtcatcacggcttttgtcctgctattatcattttgatttcagttttgtgcactcggtacactgaagttggatgcaaagcttctgatttgattaggtttatattaaaagattttgttattaagatttgttttatgtaaattacatatttataattaagctttatacatacgaccgtcgttaatgagccgtgtattaagaagtttctaaataataagacataaaatttaggtacactctatgctatcaatatatagcttagttgtcctttatatttagaagagaactgtgaggttgtacacgcgacgcaaccaaacattcgtcaactagtgcatggtccttccacgcccacgttttattttacttccccatgcctcccactgccacgtgccaccctacgctgctgcgcgcgttcactgctccatttccgtcgatcggtagcgcgcgtgggcgtggcgctcgctccctcgccggcgtcccctcgcctatatatagtttccccgcccctattccgtctcccgaccactggccggccgggcggcaccgccatcggagtacgtacacacgtcctgctgtcccgcatgccaccggccgggggagaaaaccaacagccaagccaagcccacattgtttccgcagctaggtagaggggcaaaggaggagtatagcggagaggttgatgcgtgacggaggaggcgccatggacgtcgacatgcaagcccgcggtggcggtggtagccatggcggcgaacttgacgacgacggcaaggagaagaggacaggtaatttgaattaactgatgtcgaatccatctggaggccggggtttcgtcttcctcctcattgcatgttcttgtatgtatgcatgtggcgcagggacggtgtggacggcgtcggcgcacatcatcacggcggtgatcgggtccggcgtgctgtcgctggcgtgggcgatggcccagctgggctgggtggccgggcctgtgatcctgctgctcttcgcggccatcacctactacacctcctgcctcctcaccgactgctaccgcttcggcgaccctgccaccgggaagcgcaactacacctacactgaggccgtcgagtcctacctaggtactaagctagtacttgttacttgcgattgcaaattcatcagaagatagatgagaacaatgagtggctggcatgttgtgcaggcggccggtatgtctggttctgcggcttctgccagtacgccaacatgttcggcaccggcatcggctacaccatcacggcttctgccagcgctgcgtacgtaggcgtctccctagctcctcaactaatgactcgtgctctggttagtaaaccaacaaacaacccgatcgatcgagccatgcatgcatgtctagtgcagggctatcctcaagtccaactgcttccactggcacgggcacgacgccgactgcacccagaacacgggctcctacatcgtcggcttcggcgtggtgcaggtcatcttcagccagctctcaaacttccacgagctctggtggctctccgtgctcgcggccgccatgtccttctgctactccaccatcgccgtcgggctcgccctcggccagaccatctcaggtcccacgggcaagacgacgctctacggcacgcaggtcggggtggacgttggtagcgcggaggagaagatatggctgacgttccaggctctcggcaacatcgcgtttgcctactcctacaccattgttctcattgaaatccaggacacgctgcgatctccgccggccgagaacaagacgatgcggcaggcgtcggtcctgggcgtggcgacgaccacggcgttctacatgctgtgcggctgcctgggctactcggcgttcggcaacgcggcgccgggtgacatcctgtcgggcttctacgagccctactggctggtggacttcgccaacgtctgcatcgtgatccacctcgtgggcggcttccaggtgttcctgcagccgctgttcgccgcggtcgaggccgacgtggcggcgcgctggccggcctgctccgcgcgggagcgccgcggcggcgtcgacgtgttccgcctgctgtggcgcaccgcgttcgtcgcgctcatcaccctgtgcgccgtcctgctgcccttcttcaacagcatcctgggaatcctcggcagcatcggcttctggccgctcaccgtcttcttccccgtcgagatgtacatccgccagcagcagatcccgcggttcagcgccacgtggctggcgctgcaggccctcagcatcttctgcttcgtcatcaccgtcgcggccggggctgcctcggtacagggcgtgcgcgactcgctcaaaacctacgtgcccttccagaccaggtcgtgatgagcactgcacgtacggtcccatatgtagctcaaaaacttaattacgtgctcatcaagcagtcaggctccttcattcaattccaaagcaggattaatttgggatacgtggcttaattatattggtgtgtttgcgatggtatggtacgatgggtaggagcagatcctcttaggcgtgtttcgcaatcctcctccaacattattgtaaatatgtgaatgattgattgtattccaatacagggaatatgagtacatatatacagcgcacgggtagcatgcaaggcaacagtagatagcgcaattacatccacaaatcaaggtctaattacatcatgctaacactcccccgcagtctaatctgaagcatcgctaaccgttagactggacctaaactcctggaacaacgaagtaggaaggcccttggtgaagacgtcagcgtactgagatgtcgtagggacatggagaactcgaacgtgaccgagggcgaccttctctcgaacgaagtgaagatcgatctcaacatgttttgtccgctgatgctgcacaggattgttggagagatatacaacactaatgttgtcacaatagaccaaagtggcacggcgaggagggtgctgaagctcgagaagcaactgtcgtagccaagtcgcgtcagcgacaccgtttgcaacagcgcggtactcggccttgaaagggaaatgtgcccttgggcaatttctatttatgttttggtgattaagtgctcaacacatttaaaaaagttctaatgagctaaatgaagaagagaagtgcaaatcaaagagaaggtatgtttctagacttagtacatagtttttaagtactaatatgttttatctaagtgctagaaacagtgagaagaaaagaagaaaagaattgcaaattacttggcttggtatagccaaagtcctgctcggtctggcgcaccggacgccaggccatcctccggtgaacatgccggtctcgggagaatttggcggcgtacggctataattcaccggactgtccggtggtgcaccggactgtctggtgagccaacgaccgccagcgcaacggtcggttgcgcaatccgcgagcgacacgtggcccgcgccaatagtcggcaggggcaccggactgtccggtgtgcaccgaacagtgtccggtgcgccaactgccacaaatctgcaacggtcggctgcgccagaataggaaggagatcgcgcaccggacacgaacagtggttgtccggtggtgcaccggactgtccggtgcaccacccgacagaaggcaaggataactttccttgttggcctccaacggctcctagctgccttggggctataaaagggacccctaggcgcatggaggagcgacccaagcacactctaagcattccaagacttctagtcctcactttcacgcaatcgttcattgttcttgagattggagcacttttcgagttgtaaactccccgcacgtgttttgtgtgctcatcttctcacttgtgtgcgtgtttgcggtgtggatttaattctagtgtgcgttgctcttaccaaccttactctgtgctttctttgtgatcaatcttgtaagggcgagaggctccaacttgtggagattcctcgcaaacgggaagaaaactataaggaagaataccgtggtattcaagttgatcatcggatcacttgaaaggggttgagtgcaaccctcgtccattgggacgccacaacgtggaggtaggcaagtgttatacttggtcgaaccacgggataaaccattgtgtctcttgtgttgtctttctctgtgattattgtgattcacaagagctcgctctatagccacttggttctattgcactaacatctttataaccaagcttgtggctatttagtattgaattttacaggatcacctattcacccccctctcggtgctctcaattggtatcagagccgttctcttcacttaagggactaatcgcccgaagagatggatcctaaggaaaaggggatggttgtcaacgataaggagaaggagtccatcttcaacgagccaagggacgacaagcccactgactctggctcaagtcacaagaagaaggacgggaagaagaagaggcgcatcaagaagatcgtctactacgacagcgatgaatcttcttcaccaagagacgacgacgacaagaaaaagaaaccggttaattcaaattttttatttgattattctcgtattcctttcaattccaaagctcatttgctttcaatttctcttggtaaacctccacactttgatggagaggactactctttttggagtcacaaaatgtgtagtcacttattttctctccaccctagtatttgggagatagttgaaaatggaatgcaatttgatagtacagataaccctgtatttattaacgagcaaattcataaaaatgcacaagctaccactgttttgctagcatctttgtgcagggatgagtacaacaaagtaagcggcttggacaaagccaagcaaatctgggacaccctcaaaatatcacatgagggaaacgacgtcaccatgatcaccaaaatggagttggtggagggcgagctgggaagattcacgatgatcaggggagaggagccaacacaaacgtacaacaggctcaagaccctggtcaacaagattaggagctacagaagcacaagatggacggaccacgacgtcgtccgacttatgcttaggtcttttactgttattgaccctcatcttgtgaacctcatccgtgaaaatcccaggtacacaaagatgacgcccgaggagatactcggaaagtttgtgagcaggcgcatgatggtgaaagaagcccgatatgtagacgacacgcttaatggtccattacccgtctacgagcctcaacccattgctctcaaagcaacaagcagcagggaggcgctaccaaacaaggtggcacaagttgaggcggtcgggctaaacgaagatgagatggttctaatcatcaagcgtttcaagaccgcgctaaaaggacgcaaggagtatcccaacaagagcaaagcaaagggaaagcgctcctgttttaaatgcggtaagactggtcattttatagcataatgcctcgataataacaatgaccaggaacaagaaaagcatgggaagagggagaagaagaaggcctacaagaaggcaaaggacgaggtgcaccttggcaaagaatgggattcagactgctcttcttccaactctgacgacgaaggacttgctgccttagccttcaacaagtcctctctcttccccaacgaatgccacacttgcctcatggcaaaggagaaaaaggtaagggttcgagaaacccct

SEQ ID NO: 118 - DNA, 6368 bp, Zea mays
  misc_feature (1)...(6368): Genomic fragment
  misc_feature (2627)...(2666): n= A,T,C or G
  misc_feature (4891)...(4930): n= A,T,C or G
  misc_feature 2627, 2628, 2629, 2630, 2631, 2632, 2633, 2634, 2635, 2636,2637, 2638, 2639, 2640, 2641, 2642, 2643, 2644, 2645, 2646,2647, 2648, 2649, 2650, 2651, 2652, 2653, 2654, 2655, 2656,2657, 2658, 2659, 2660, 2661, 2662, 2663, 2664, 2665: n = A,T,C or G
  misc_feature 2666, 4891, 4892, 4893, 4894, 4895, 4896, 4897, 4898, 4899,4900, 4901, 4902, 4903, 4904, 4905, 4906, 4907, 4908, 4909,4910, 4911, 4912, 4913, 4914, 4915, 4916, 4917, 4918, 4919,4920, 4921, 4922, 4923, 4924, 4925, 4926, 4927, 4928: n = A,T,C or G
  misc_feature 4929, 4930, 6329, 6330, 6331, 6332, 6333, 6334, 6335, 6336,6337, 6338, 6339, 6340, 6341, 6342, 6343, 6344, 6345, 6346,6347, 6348, 6349, 6350, 6351, 6352, 6353, 6354, 6355, 6356,6357, 6358, 6359, 6360, 6361, 6362, 6363, 6364, 6365: n = A,T,C or G
tttcttcttgacctaaaagacaacccaactggctatttgtgctgaactgtgctaatatcccagccccagggtagtcgctgactgtatacaacaatatagcgcggagttgaaacacctcatctcgggatgcatcatatgttggcataccaatgtcaaataattcatttagttcatcataaactggctgcataaatgtatgaaagtcctttcccgggtagcctgtaattatcagagtaagcataagagaagatgctttcatgcacaaccatggaggaaggttgtaaggtaccaatacaacaggccaacaactatgcgttgaattacacttcccatatgggttgaatccatcagttgctagtccaaatctcatattccgagaatctaatgcaaagtcagggtgctgagtattaatagcattccaaatttctgaatctgcaggatggcgcaatgccccatccttagtacgctcctcatcatgccatctagttaacctggctgtttctttatgcaaaaaaagccttttgagcctaggtttgattggaaagtagcgcatcaccttatttggggctgcctttcttttttccttctttgtcaatattgtgttatctgctttacctttccaccttgaagctccacattttgaacagaagtcatgatcttttttatcatttcgatacaactgacaattatttgggcatacatggattttatcatatcttagaccaagctttgcactgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagagctttgcaatgatctttcgagcctccacaaatgttcttggtatgttggaaccatttggtagagcgagttgtagaattgcaagcaaatcatttaatgatttgttgctccacttgttgatggactttatattaaacaaaagaactaggaaggaaagttttgatagttcacagccctcccacaaaggttgatcagcatctctaagcaattcaaagaattcttgtgtttctgcatctggtccaactttagaagaacctgctgcacctgattcatttgtgtgaagtccattgtcaacatatccaaaagcgtcttgaactacctgacgcatgttatggtttaaactcggacaatggaactgtgaatctttgttagcagatatatatgatgctgtttccccatggcaaccccatatcgtgtatccacgtagcattccattgcatattaagtgatcatacactatagattgcttttgtaacatcctggttgacacacttgacacatgggacaccgaatctttgcattagaatttttgcctatgtatgcgaacctgaaaaaaatcccttannnnnnnnnnnnnnnnnnnnnnnnnnnnnnnnnnnnnnnnaattgtgacctactgaaatctaggaggaaaaataaacattggaaatagataaaaactgcatgtaaacaacaatgatataaccttattttcaggttgtaaatagcaaatatcactaaagtgacaaacataagcagcaatatggacacttttttttggaatctttagtttcttaattgcaaaggtagcaaatagatacactttgagcatctacaaaaaatatgcaacaaatttggtattcaaattaagtctaaatttcatcatcctctaaggttattcttcagtataaagtgacaaacttgatctgccagttgcagcaactatgctgttttaataaatccatatatcactaatctcttatccaaactgggtgaataaacaatatgagcaaagctcatctaacctaccacaaaacactccatagaagtcatacttgattctgcctctaaccagttttaaaacagcacctaaacctgcacattgcaactgtgactagaatctgacagaacgtgacacataaattcagaaccccataactctctctgtagccaacgaaattttgcaaatagatactcattggaaaggttatgaaattatcaaaaacttttattataacgagtgtctctacatcggtttacaaaaccactaaaacagcccaaaccttctgttgcaaaactgataggagagaatagcagacagctaaattcagaatcctatatctcctaatgtactcaacagaaaattgctaatgtgtactggccggaaaggttttgcaattctccacaacttttgtaataaatgtgctcccaaattcctcctttataaccctcaaagatgcatgatatacaacaaaactcagtgatgtgctcaagtatcctttttgatagggtctgcaccttaactgaaattgcagttaaacagaatttgtgtgcttcagaaatatatatcttaataaaactgaatgatacctgtaaaagctcctttggagagatcaacgaggtcgtgtagcgcaaagattagtaaccagagaatcagagaaacaagatgagagggggaaagagaggacgacactgtagatggattgaggatggacttctcctaaaccttagctgcctttggggaggtacaacacgatagagtcaggacggctagatgggactacatcatgggggccgtatggtgtagtttgactgagtcaatggcttcccaccaaaatggcccgagctgttcagttagcgaaaaaacagagcaagcagttacatctcctcttaccccttcattcgactcccatcttgcctccatccccgagctccctccaaggtcatcctcaccttcgtccccaagtgtgagtaaactctgctcttcccatggatatgaatcgcctccaactcctgatcaatccacccccatctggtgtcatcctgcaggttcaaagtggccactggacttcgctaccataggattcaaggccttgttcccgaacaacaccatctacaagggcctgtgccggccatcggtataatttggtactactacaactcatagtattttctaaactaaaagggtgcccctcctcctcgatcatcaccattatgactccttgccctctcatgtcaaggtagtatatcagatgaatactgccctactgtttttacttgcaaagttcaactgcccgcaccagaaagtcgctatcaaattattctctcactcactctaccattttcacgtatgtggcagcctggctttgtgtctgtcttcttcagtgaatgcctgttatataatttttctgtctggtgcacttgcatctctaaattgtaacaaataaagagaaaaaccatttgttaatagaggaaaatctattgatattcaggtggtgcattcacttgataaggcacatcttctgctcaccaatttagcctttctttcagttttagcatttcttgttgttttagttcagcatacctatccaattatgatagcacattaagttcagcagattagttagcaatttagcctttcttgctgttttttgaacataccatattcttttctcatgggtgctcaattttaattagtttgtgctaccatggctgaggatatttggaccctaaaacttcaatttgagggggaccctccaggacagaaaatggtgcaaagggagatgggacaaagatgagatatgtttcttcaaccttgattggaactgattgggggaatatggatacgannnnnnnnnnnnnnnnnnnnnnnnnnnnnnnnnnnnnnnngatatgtttcttcaacttgattgaactgattgaggaatatggatacacatcagttgactatgtatactacaagagaagagatggtttggttgcaatacaatgggattcagatgtgatgcaaatgcttgaagagaatgagagcaaaaggaaggttagcttgtttgtgacgaagcagagaatggccaccatagcacctaccaaattcaatgaagaacctaccaattctgcagaaaataaaaataaaggtagtagtatgatgaaaataaaagttgctctttcgtgtatgtttgagcatccaggtaaaactaacgtacaattgtcatatttgaatgtcatgccatgtcatgtcatgtcatatgaaaataattttgcagaatatatgtcatccaatagcaggtatgtcaatttaactgatccatgagcagtgattttgcatgtcatcttatcctagcattggtgtatactataaatattctatactctggtatatgttttcacttctcccataattgttcatagggaaaaggggcacaaaggaaaagcagcgcctaaatgtaatccaaatcaaagaacaatattataatgaggttgatcagcaccatgacaataccatccagcaaacacaaggtacaaatgtatttggaataatccaatatatgtgaactgcattactaatgtgaactttattttcataggtgatggcaataatgtaatcaagcgaaagggaacggttttgacacatgtttgagatttacctaaggataaacgtatattagtgaaatgcaaccaacttgggcaacctattggaaaagaaggtggtctgttaggccaatttttaggaactatagcacggaacggtggttattgcccaatagatgtcaatgattggagaaagataaagaaggatagtgctgaaaccatacttcaatgtattcaggtatgctggtatgaaatgttaagtacaatagtagccatgtaatagatttattaatggtgtttatcttattttagacaaagttcttgtatcctcgatcatgtgagaaatggatactgaaatcgatagggagagattggagaaaatacaagtcaatattgaaaaagaagttatatagtccaaagaagaaaaaggtcatacttatacaagctttgtccagatgatattgatgaagaccagtggaaatccttagtaaaatattggaagtcatctgaaggaaaggttagtacaatagtgcatcattattgggcctactctctttggtttatatactagctcaatatcacttaatttactgtactacaggctcttagtgagaagaacaaactaagttgtcaaatgaagaagacaacacattcagggggtacaaagagttttgcacgttggtccaaggacatggtttgnnnnnnnnnnnnnnnnnnnnnnnnnnnnnnnnnnnnnnnn

SEQ ID NO: 119 - DNA, 3000 bp, Zea mays
  misc_feature (1)...(3000): Complementary strand for ZmDGAT1-2(Mo17) promoter
gcgaggaaggttccagaaggtgagggagcggggctttgggggtgcgatactttggggcagcggtggcggtggcgaccttggtgcctggtggggaggggaggagccgaggtgcgtgttttgatgcgggtgttgggctgcgcggcggctgacgcacaaaagcgcgggggcgagatggcggcctcgaaaaggggacacgtggacgggcgagcttgccaggcgtcctcaccgtcaccggcttggttggaagggtccggtcgggcgagtcgtcgcaggcagcagtcgggagcggggagcctgtctgtctcgtttgatcgatcgttccagccgcgttgaggctgaggatggcacgtccctcttgtggaacgtacctaaagatgggagaaaatcaaacttggccatggagatttgtgtgctccggaaaatccacacctgtaagcaccacctatatcattagtaaacgtgcctcgtacaaaatttaacatattttaaaatcaggattcctacaaacattcaacacgaattgttctaaaacttacatgagcgagagtgaaccgttgatcagggttatttatgtagaacatgtttggttgccatcattaaggagtgtttcggaacacatttttaaaaatatcacagtatacaaaatgtcatgacgtaatattattttttattatattaaagtatcaatttcgatagtcgttctgcgtcatattttaaaaaaacatcctcatatttctttataaactaacatgcggttctctttttcatctatccgtagtacgtacgcacacaacaggcttcgctcagccatgcggcatccctggtgtctcgtccattgggtttatcgtttcccaacgactgcacgaaccctccacgcacaacgcggggtctactccagactcatcgtgctctgacgccccacgatctcccaacagtagcgagaaacctccacgcacaacacggagtctatcgtgaacccaacgcacgcggaccgtccggtgaaatccagtctagcccaagtttggctcttttgagccaaaccccttcacttcttttttactctctttttaatgattcctattatttagacaaatatagttagcaacaaaaataattgactaagagctagaatcatacatttatcacttcatttcaaaatggtttgcaatatgctcaagctaagtccaaataatgccactttactttcacaaacaagttagtagtcaaacaaaggtacaagaaacaaaatatagtgtaagtgcaacttattcaaatacttaaaccttctgtttttatagttttacccaaggttacactttttgtcttccaatccaactcattttggacttcacatattcaattttcttgacttaaacctgtgctcatgctcatatgaacaatgttagttaaaagtggtgtgttgatcatttaatcaccaaaacaactagaaattgcccaaggcacatttccctttcaatctccctcttttggcgatttatgccaacacatctaaagcaactcaaagctactaacataactaaatatgagccaacttttgcaaattgaagtcaaatcaaacaacaattgaataagtataggatttgacatatgtggatcattttgccaccactcgttttgaattttgcaatcaaactcaattttctcacttttaagtcaaaaactcttttagttttgcaactcaaacaatttttagaaattagttttgatcaagtgtcaaaaactcccccttttccataataaagtcttctcccccataagagaatagttttgcaataagagagctcctctttgcaatcaaaaaggtcaggatagagtcgagtcggacttggcttactcttgttgtgaacgtcctagcttctcctccttgacatattggcctttcccaagttcttgctagccctctctaaggttcctaatcatcaaaagattcacgacaccaagcataagctctaaaacactattgactaggttagaactaacttggagatttagctgttgtgcacctgctcgtgttgccggtccatacattgtttgtatgggagtgaagtcctcatcaaactgggatcgccaccacctagaagaaactaggtccctctagggtggtctcaaggacttcgtcttcatccacattttcccttccgcggtggttgtcgaaggcatgcgccctttcgtcgggtgttaaggcggtgcctttgctccgtggcataggcccgctcaagggtgtctttgcttgctgaagatcccttgtctgttggtgccttcgctattagtgagccccctcttgcgcgggccttcatatagtcattgttagtggagaccatcgaagggaccttcgttggtgcgggtctggcgaagttctctaacgcgtggaacactgcacttaaacatgggttactttcggcctacgcagggctgatcaaggtcgggttcggccttcgctccaataatcaccgcactccaatcgccatcgagccatatagatgctgattgccaagagtaacaagcactagacttttacttggctaagataagcctaatgtgggtggtggatgcacacaaatctctctttaggcactaatgaggttgctaataacaagatccacaattctctaatctcctcacggtgctaagcgtcttcgtttctctcaaaaggttgctttagctattgaaaggggcaagacatcttaagaagcaatggacacatccggtgttactgcaaactgtgcaaggcatgctttatctattttttgtgtttccttccaaattttgtgtgggctatcttggattatcagtgaaagtatcctgggggggggggtgaataggcggaatctaaaatttacaaacttaagcacacactacaagccggggttagcgttagaattaaattcgagtccgaaagagagggaaaacaaatcaacaaggaaataaagcgaatgaacacgatgatttgttttaccgaggttcggttcttgcaaacct

SEQ ID NO: 120 - DNA, 728 bp, Zea mays
  misc_feature (1)...(728): ZmAAP1 promoter
tttgtcagacacaagaatatatatatacctggtcatcacggcttttgtcctgctattatcattttgatttcagttttgtgcactcggtacactgaagttggatgcaaagcttctgatttgattaggtttatattaaaagattttgttattaagatttgttttatgtaaattacatatttataattaagctttatacatacgaccgtcgttaatgagccgtgtattaagaagtttctaaataataagacataaaatttaggtacactctatgctatcaatatatagcttagttgtcctttatatttagaagagaactgtgaggttgtacacgcgacgcaaccaaacattcgtcaactagtgcatggtccttccacgcccacgttttattttacttccccatgcctcccactgccacgtgccaccctacgctgctgcgcgcgttcactgctccatttccgtcgatcggtagcgcgcgtgggcgtggcgctcgctccctcgccggcgtcccctcgcctatatatagtttccccgcccctattccgtctcccgaccactggccggccgggcggcaccgccatcggagtacgtacacacgtcctgctgtcccgcatgccaccggccgggggagaaaaccaacagccaagccaagcccacattgtttccgcagctaggtagaggggcaaaggaggagtatagcggagaggttgatgcgtgacggaggaggcgcc

SEQ ID NO: 121 - DNA, 3000 bp, Zea mays
  misc_feature (1)...(3000): ZmPESP(Mo17) promoter
caagtctccctttatagtacaactaaagtaaaaaaataacgataatatcactaacctaagtgtctaataattttattgacacttagaactagttgttacttaactattttgagtatccatttaagaaccgaccgttggtatccatcaacaagggcatgaatgtcgcataagctcaatcatcgtgcaatattatgttctaacttatcttatttctgcaaaaatacacgttaatcataacaaaccatatgttgttattaatcactagaaccaaacttaggactagatatctttttaatatgttttttaatctaaagtaattggaagacctaaatattcctttttgttttcttatattttgagatctaaaactagatttttcgaatggttaagtatagattgtatcaatgtctaaggccgttcgatcattttaagttttggatttcaaaaaaaaaaatctaaaacagtagaacaaatgttcaggattctaagggctcgtttggattgatgcctaacttgctccactttgcctaatttttttgtctaaggttagttattcaattcgaacgactaaccttaggtaaagtggggcacagttagccacaaaccaaacgtgccttaaatgtgcttattcgtctatatatggtggttgctttggacttctcgatggtcctgaatctgaccctaaggaaggcctcgattcagcccactaggttcggcagagtttgaagccgaaggaagaaaacgcagtacatgtacaagacacagatggagatggacacactcacacacaggtcgtcgctcactccactcgctcgtatcgtctcgtgtcctatggatgcaatgcaagtgtatttccagaacacatggcttgcttgtactgggaggaattgggcgcgctgcagggcaggctgcagccagccgagattattgcgagttacgcacagtactctactgtttttaccagtgcaccgtacgcgagggtgtagacgaccaaaggtacggtgtctcccgtacgtgcagcaggatccccacgtttccgacgaagactttttctctctgatatatttgttgtacgtcgtgcagcctgcagggcgtttgaagacttgttggctggctcgcatcgcactcgcacccaatcaaaaagctagaggacgcttctgacgcagcgaaggcacatgcatccagcctcttcgtcgtgaaaaacgtaaaagatcagatagaaaagaaatcaggctagcagctctgaaagcgaccgtttcttttcccttccattttcttggtgacgaaacacgaccggttctctagcctcgtgcagtcgtggtgcatcgcggccggtttatttggagttgggcgtttgaccaccgagaagtggactgtggccaaaccagctgatcagaggccaccactgacatcgagcatcacgcataataataatgcattaattaatgcccacctgtgggaggctgggggctggccggctgggggatggtgctcggctgaagtgaggccggctccaatccatcgcagcagctagccgtccaaagtgactggcgtcttcgctttgcacctgcaccccgccgcagcggggcggcgagtgctcctgtatgaatctaacggtgctttggcccgcatcccctccacctccacctccacctccacctccacatccgtggtggatcctagttagttcggtcctctccctccatgcctcccgacgaaaaagcagcgtgtggtggcagtgacgaccacagcgaaaaaagcggcaattgaaggcgatggtgtagcctggagctggagtgggcgctcatgcatgcaaccgccgccaagtgctgctgccgcaaccgcaatagggcaacgatgtggtgtcgaggcggatacaggatataaaattcagttacagcgattaggcttgttttatcttatcttttagagtgcaccgtaaagaacaaataatattaatttagaaaacgaaacttagagaacgttgctgtagacagccttaatgtgaatcagtattttgtgcaaacaagtttataggcttagggaattggttcgcccttttctttacttactataagatgatgtttgaatgcactagagataatggttagtggataaaattagctagagacatccaaacactctagctaacagttcaaatattagctatttttagtaaatttgctactagttagctaactatttattagctagctaattctactagtatattttagctaaataactattagttctaatacattcaaacaccctctaaatcaccagtttcaacggttattctacgtcatcacttttacataaggccctcacatttctttgaaatcaacccaaaatcccaccgtcactcatgtgtcacgcgcggagcgtatatctatttttactctacgtctcgttttacaaccgtataagataagtcttatctcatcaccatgagtgtgcgcgaaagcccgtatatatgattttattcccacatctcgtctaataagataagtattgtcttttgcatacggaaccaataatgtaaccaccatgagcatttatattaactctcaacttctatctatatattattcgttttttatttttatgtaaccgttatgtactgatattttattaaatatttatgtgtccttgtaaacacgggtattgtatttagtgtacctaataaattcgctcgccgtggccacaaaatcacgacaacaataaaatacgtacacttggaggcgaagtcaccaacaaaacaagcgtctccctccaccggtccaccccccctctggctctctgcttctgcacctgcgtgtgctagcgcgagcgcgtgcgtcccttccccggcacgagcggcgcacaccgtcacatccgcgctccgttcgccttccagaaaatttaaaccccagcggagccggccacggccagtcagccgccacacggtctccgacgcgctgcccgctcgcctgccaaacccccaccccctcggcggcg

SEQ ID NO: 122 - DNA, 3000 bp, Zea mays
  misc_feature (1)...(3000): ZmS24 promoter
ttaaaccggttgtttaaagtattcaaatagatagagaaccgtttagagaaactctacatatagaggatccagcagcgttatctaaatttagagaaccgtttagaggacgttgctggagggagtagaggacgtcctcgtcctctaaatttagggtacagaaccctttagagggtcttgttggagccagcctaatcccaccaagtcattgtcaaggtatacgtacgtacgcgagtgatctctcgtcgtcccatgtacgtatgtatgaccggtcgtagtagttcgcatttgctgcaagtggccgtatatagtcggtcgatcgagatgaaaaagacacacggcaaggagatccttggcgacctaccacgcaggtgacgcagtggacttgcggagttgagagtctccagagttgttgttgcttgtgcatatgtacaagcgcgctgtgtcaaatgcacgcatgattactggtggcgcttacctcaggtggccgtggcactgcctgacgttgcgcgtggaaaaaaacggtaactatgctagtgtttgatttagagtacagtgaaatgaaaccgctccgtttttaatttatttttgtttagattatttatagagtggtttaaaaaaaggaaaattagacttaaatgatgaaccatctggttcttcaaaatcttttaaacggaaccagtttttaggatagagccattctatcccagctgactctggaaccaaaacactatctaagaccgtgtagcgaagctatatatgtgtaccggtggtcagaaagtgtttgtttccatacacaaaggacctgtgaaaatcgtaacttcgttgacgtcttctaaagatacgtcaatgtaataaatatatttacaccattgattttattaagacaacagccaacacaaacctatttacaccgatggcggccgtgtcaataaaactgccgaagtaggtgggtacagatcgaagaaagctgcatgtgtaaatagatttacaccagtgatttatctaaaggcagacgcctctaaaaatggattctcagagacggtttaatagcatatatgaacctattctaaaattttcaagataatttcaccatactactactcaaccttatccaatcctaatcaacaatatataacaacgtattgaaatatacatcacatacaatcatattttcatacgtgacaaaaacaatattaacttaactcaatcatagccatcaatccaagtattaatttacgtcaaccatatatatagaacacatttttttattcccggcgtgtcaataatatatagggtatccagatcaaacttaacaacaaggcatgtacgaataggcccatgagctcagccacgagagtccacggactcggtcctcatgatcagaaggaagtctaccgctaggaaaatctaggagcattaatatggcaaagatctatccgaatatggattcaagatcctaacggagacaaatatcctaaggtcttgttcgtttctatcggattggtgggtcggaacgaatcctaaccggattacttctctaatttatataaactttgattaggtggaatggttccgggtgcaatccgacacaaacgaacaaggcctaagaccttgttcgtttctgtcggattggtgggtcggaacgatttctaaccggattgcttctctaatttatataaactttgattagctggaacgatttcgggtataatccgacacaaacgaacaaggcctaatggataaggcaaaaatcctagtggataaagaagacacactttgtaattatagctagagtcggattcatatataactagataactgaattgatactgtcatggactaggtaaccaactcggtatctattatataattgtcccctttttagactataaaatgaggagcgaggaagcccttaggagaagatcacatctcacataacaacatttcgatggcggggcacttgagccggagtgccgaactgctggaggatactagggcacacacgccttgtcgactccatgcaccggccactgaacttgcttgtataatttttttgacatcgacgaatatagcctatgtcgaagacaaaacaatttatttcaactaaaagtacttacccatgcatctgaaccttaaattcatttctgaagcggctctacggtaaattctctttttaaagttacagtacctgagagcatctgcaatagatcctaatatcatcatctcaatccagattttaggggaaaaaaagaaaacaaaaacaatcatccaatagtaccttcgccatgaattttggattgcgttgggtgtcactgtcagtgacgacatctgctgctccaacttgcataggaataggataccttgccccctgcctacatcaggacgcctccctatggaagcgacgcacaaactacatattacgtagagagtcttcgacgttagctatcatcctccgtttatgtctcgcagatgcccgcatgtgggcataccatctgaaaaacaatgactccgttcaagagactgcttggtgtggttgcctctctcatgccctctcgtacctgtaatttctctaccccttggagtagtttttttctggccgttaaggctaatatatcggatgagcgttttctacccacatagaatttttttaaaaaaagttggagttgctgtaatgccgaggtactagagcctagaggcgtccctgaagcttttggattcaaagttgaaacacgcttttttagaactgggccttaaataaggttggcattgactattcggcccaaatccataaaacgatgaagtctgggcgttttcaaatcagattcagcccacaaggccataacaaaatagccccgccccccctcccctagggtttcactacatatgtaaccctctcgcgcaaacactcctctttccgcgccgcctcccctcccgccctcttgctccgccggcgcggccaccgccaccgccaccgcaacagctagtcagcagatcgtaacc

SEQ ID NO: 123 - DNA, 3000 bp, Zea mays
  misc_feature (1)...(3000): ZmABCT promoter
catcactagagaaagtatatttagaagatgttcttgtggataccttcttcttactcttatttgccatgaagcatgtgtggtcgaccttcgagaagagagagcttttgttgaaggcgagggtggtgacgccttcatcatcgaactcgaaggagctctcatccgaatcccactccttgtcgatgtgggctccgcctccttcttcttgaagaatttcttcttcccattctcctcttttatgtcatcattatattttgcatatggacaattagcaataaactagttggtcttaccacattcgaagcaagccctcttaccacagggcttgtagcccttgctatttcggttccttaggatttactggaagctcttgataatgagggccatatcctcatcgtcaagccccaaaacatcaatggtttccttctacttgggccctcctcgtttgttggcttcaaggaaacaatttgtggctcaatggaggtgatgtttccttgcgccaagtcgtcgatgagcttggagtccttaaccatcatcgcgtggattaggaacttcccaagcacatcttcgagcgacatcttcttgtacctagaattctcacaaaataaggttacaagagtagcattacgaaacgtaaaggaccttagcatgagcttgatgacttcatgacccgtccacttattgcttccgaggttgcgcacttggttcaccaagttcttgagccggttgtagatctcttgtagcccttctctcttgatcatggcgaactgaccgagctccccttctaggaactccatcttggtgaccttggtgatcttatcaccttcatgcgccgtattgtgtgggtatcccatattttcttggcgctctccaacccgtccatcttgttgtactgcttacacaaagaagcaagaagtactacgatggtttacgagttacgatggacaatttgttccacctccactgggttgtaccccttgtcgtcgtcatcgggtatctacattcctaattcaacaacatcccaaaaaattggtaggttttagaactccaccaacaataatctgcaccatcatagtgtggtgtttttttccaagtggaacagaaagtaaagggatagttgtattgcgaggaatgcgagagcaattgaaagacatctaaagctttattcttccctatatcatggagcacctttagagcatctccaacaaataccttaaatcagtactctaccttgaaatgtagggtcgaacccataaaaacggcacaaactgtgctgcattttacaaacttttatcaaaaaagatacatgacacactatgaagtgacccaaataatatactactccatagtacagtccaatccctttattctatatcattctcaatattttctttcataataaataatttacatcctataatatatgattttgggtttaacgttagaattcgattagggattttgtaatattttaaatgatgcaatattttaaattacaggacacttttttgaggtattttgttggagatgctcaccgtacacaccattggccgaccagttatccgaaaaggaagaaaagctagaaaacactcttggatggacggtatcgtgattccctttgtctccgcatacagaacgtaacgcgacggtcgtgctaactgacactatatatcgagtagctagcgaggtcgatgtgcctggcagtcgtgtgcacctacagaacctggcacgtacgtaatcactgaactgctcggaagtcggaatgcaggcgaagcgactaggactagctagcgagggcgctggcacgtacggtgacggtacggtagcagcggctgctagtcatcggccggccacctgcgctcctgaaacggcggcacaaccggccacctgattctgatctgccgagccacgtccaccgcacgacgaatccgccgcccgccccgccctcaccgtcacgggccggctgtgcccacctaccgacgctcgcggttcgtccgacgccctcagcaacccgcactggtcggttggtttccctggggacgatgtccacccaccgcggtcccctcgggtcaaccgcgcgcgcagagcgctgctattccctgcccggcgcggcggcgcccccatttccccgcgcgccagctagctcaagagtagggctgaaaaaaaagctcgagccttgcgagccggctcgggctcgatcaggctcggctcggtgaggctcgtgagcctaaacgagcccgagccgagcctaattccatggctcgctacactaacgagccgagccgagccggctcgaggctcggtccaaactacttcttacttgtatctccgttgaccaatgtgtaagtgtgctgttttagtcacaactcacaaggaactagagtgcagggacataaatttttattatatggaacatattatgctttaaatttgagttaattactatatttactgttgttgagtacttgagtgtacaggctcgcgagccgaaccgagccggctcgcgagcctatatcgagccgagccgagcctcgttaccgagctcgctaagtgatcgaaccgagcctggctctgctcgctattccaccgagcctcaccgaaccaagcctggctcggctcgtttccagccctacccaagagcgcagcagcgcgtataaataaacggcgcgctcctagtcctccacctcccgctcactccgagtctcactctcactccgtcctccctcttccttacagaaacacaactcatgcagctcgtacggcaccaccaccaccaccaccaccaactgccgcactgacacatgcatgcgcagaaagcagctagctagcggccggtggccttgagagccgctcgctagcttttaaaattagccaccaattcaatctctagctagcttgggggagctccgttcctagctacacgtacgggcggcgcggcaacaccaccagccgtgtagccgacctagtacgttggagcgaagcatatatcggcggccgtatcac

SEQ ID NO: 124 - DNA, 22 bp, Artificial Sequence
  DGAT1-2 ASK forward primer
ctggaaccttcctcgcatggcc

SEQ ID NO: 125 - DNA, 22 bp, Artificial Sequence
  DGAT1-2 ASK reverse primer
cggaagatggcgtcagagctga

SEQ ID NO: 126 - DNA, 22 bp, Artificial Sequence
  DGAT1-2 ASL forward primer
ctgggcattttctgggatcatg

SEQ ID NO: 127 - DNA, 22 bp, Artificial Sequence
  DGAT1-2 ASL reverse primer
atctacttgcctgggcctgcct

SEQ ID NO: 128 - DNA, 82725 bp, Zea mays
  promoter (9306)...(12305): ZmPESP(ASK) promoter
  misc_feature (12306)...(21370): ZmPESP CDS (exon and intron sequences)
  3'UTR (21371)...(21794): ZmPESP
  promoter (29472)...(32471): Complementary strand for ZmDGAT1-2(ASK) promoter
  misc_feature (22774)...(29471): Complementary strand for ZmDGAT1-2(ASK) CDS (exon and intron sequences)
  3'UTR (22365)...(22773): Complementary strand for ZmDGAT1-2(ASK) 3'UTR
  misc_feature (39468)...(39507): n= A,T,C or G
  misc_feature (43945)...(43984): n= A,T,C or G
  misc_feature (1)...(82725): ASKC28IB1 genomic fragment
atctttattttagaaaaggagagaaataattaacaaaagggggaatcataagaaaaacataagatgaagaaagttgataagtgcattccatgtcatgagcatcacgtttattttatgacacactgcaccctatgaatagtatgatataagttgtctactttgacctaaatatgtgcttttggcatttgagtacaaaagtggtattttctgaaatgcacatatttagggggaggaaactatatcataggtagggggaggaaactatatcataggatttaaaatcttatttatcaaatcttatgtaagctttaaatgtgttgtcatcaatcaccaaaaagggggagattgaaagtgcatttatcccttttgtgagttttggtgatttggataacaacacatttaaaggtctaacgagtttgctaagtgttgaacaggaaattcagtatgatgaacatacttgaatagtgtataatgatcagtgaacaaaagttcaacacgaggttaaataaccaatgagacaatgcaaatagatataatatgatctctatattggtttgaatatatggacaagacctgagaaatcactacatacatatgaccagaatagaggacaaagtgatttagaggattggacaagccaaagagaataagatatgaggaatcatgaattggcttgaccatattactatcagtccatatatgcttctatgagaatcaaactagagcttgattgatcttgacaattatatctagaagacattcaagcaaggttcacaatattgaagaaatgattctctcaatggatgctcaatttgatgtgactcaagaatggcttgatagggtgaagatagcaaggaaagggcttcgaggaactaagcgaaggtgaaggtcaagcgacggcttgtagaccgaggtaccatggctaaggtgaagaagagagtacttgcactaagtcgatgaactaatcagctatgaagagttataacatgttgatgcatcagtaaggtgacttgaagccatgatttgaactcatataaggtgatatggtacaagtcacagggtttgatttgagtttgcttcaaaaggtgagacaaagatgtttgtgatccttatgaagcaatgccatggagaaatcacacatgagacaccaatgactcaaggagtttacttcattttattttatttaacttgagtataggaatcgtcgtactataaagggggatccaaaaagaaggttggtgtttgccaaagctcaaacctctctattcaaaagctatttatgaaaagcaaaaatctctttatcgttctatggttgaccatggttaggtttgagaaacctagagtgttcttgctgaaaagcagctgaacttgttcagctgcagctgagcttttcagctgagctggacttcagctgagctgagcttcttcagctacagctgagctggacttcagctgagctgagcttcttcagctacagctgagcttttcagctgagctgaacttcagctgagttgagcttcttcagctgcagctgagcttttcagctgggctgaacttcagctgaactcaacttcagctgtgaacctctttgaccatacaccagctgaacttgcctctgggcagttgagctggggttttctctcctaaactctctggtcaagaccggttgaactggtcctgaggggcagttcagctggtctctgacccctctgacctctgatctgcagtctgccagtcagactggcaaacaggtcgccaggagctgtcaggggcggttcaaccgcccccccctgggcggttcaactggttttggtcaactttgaccagtctgcggtcagtctgcgcgtcagtctgccagtcagactggcagacaggctgccaggcctgccaggggaggctcaaccgccctagggggaggttcaaccgccctcaaacagaaaaatctgcccaacggctagttttgagctccacctatatatactacctcctacctctctccctaaagaagtgagcacgatttgaactccatttctaacccaagaaacacctccctctctctcacacacatctcttgcctctcccatttcaaatctttggagagaaatctttgagtgagcttgagagctgcggtttttgtgcttcatctctaaatctctctcgctcttcttcattcgagctttggtactacatcgagttctttgtggattcattactcttggagcttctagctcctagacgactaggtgtctcttgtgagtctccaaatcttgtggaagaccacaagaaagtttgtattacccgctcgtttgagcaaagattattgtgtgggcttgacctttgtggtcggcaaagggaggattagggttgaaagagacccggctctttgtgggcacctcaacgaggaagtagggcaccttttgtggtgtgaccgaacctcgggataaatcttgtgtctcttgcgttcttgctcattgtgtttgttcatgttcttcgttctctcaccattccgtggaagatttgttcatatctttttggtgtgtggattttgagaagtgcccttctcagatctactactttgaaccctgtggatcatttagaacatctcatttccaaagttaactgggtgaatttcgagatcaattcagttttacccagtttgcttctagtttttgttgaaaaagttttaacttgcctattcacccccccctctaggcaactttcacatttatctctatacactctgttattatatatgttgtcttcttggcgcatgtatgagatgcacccggctttgtcccttaaagcccgggtgttacaagatttttatggcaacaagtgttaatattgaccaaacaatgtttatgtaggacatttttaaacatcaacccaacttgaggtatccattgttattagttatgtcaaaatctacaaatgactcataaagactaaagtttaaatgcagcaatcctgagtaacgtctttattcaactgattgacaagctgaccatgggattaaaaacttcataaaatcgcaggtgagtgaccataactcatgagcaaaggttatctcgcatggtccctcacacccttgtcctatacccttcttgaaaggaaaatgggatttaagttatttctagatttctttgttacttgatgatcatcacaaccatctgagctaactagtttgttgtgtttgatcataggttcataagatcgacaaatcatattctaagtcagaaacaactcaaaacagcctaagaggcgtatattttggagaagatgagctattggtagttcaacatcttggtcaatttccaaataccctgggaacatatttgaagtatctagagaggttgaaaagctcatgttttagttttgacattttttctagctaagtttgagccataattggaatatgagttagaagaatcaaagcaaacaatttcatgacttagactggttggctagtttatatatatatatatatatatatatatatatatatatatatatatatatatatatatatatatatatatatatatatttgtctaactcataggaacaccctcaaagtcagccaaaataagttgaagaagaaaagcataaaattcagtaaaaacacctggtctgcgactcactagaccgatccggtgtgccactggactgcgtacgcagagaacccttcttcaacacttcgacaacctgtttcatcaaaccagtccggcgtgccaccgaaccgaagttccagagaggttgttttggagaagctgaacaccctggcgcaccaacttagtctggtgtgccacagggccatgaagttctaatggttactttccagatccaatggttgagctgacgtgtcaggggtctagtgtgtcaccggacaagcactgtgcaacctgacacttcaaaacattcattggtcgagtagtctgactagtactgttcaagggtcgttgtgctcgcaaaaagagcctttttagcattgatgttcaatgactatatgggttgttggaggctatgaatacatcccagctatataattcaacacacaactcttgagcattcactcctacaagctagagaagcattcccaacacctccaagtaatccaagttccctagttgagtagagttcatcctctagagagaaaagaaagtgtgcacttatgcttgagctgaaaagagagagtgtcttggtgaaaggaacccattgagattgtaaaggctagcaagaggctttaatgttgtggagtaccttgcaggagacttaggtctcttgatcatttgataaaagagaagagggatcgagtttgaactttgaaatcactcgagagggttgaaagagacacatcctttggggcacctcaacgaggacataggttctttggaatcgaaccttggtaaaccaaatcgctcatgtctttcgtttgtgttctccctcttatattctaaagctctccccgctccgatcgtattacttctcgctctaacacctaatttggatcaaagtttttattgttgagtgttaaatttcagatttcgcttattcacctcctccaggtgactttcactttctgttgatcgatgattatgaatctagcatgcatcgactactagctaacatgaattataaagggaagtatggttgtttatctactagcacacaaacagtaaatcaaatcaattttgtgtgtgcatagagatggtgcatggaagctcttcttttattgctgcttagacaacaagatgccaaagaaagccctatcactgttagtcgagagagctaaaaatttcatctcatacactagtttagaatttagatggtactccatgtttcatctaaccaccatggttgatgtcaaccttccgaccactagctctgcgatcctatccaccaccagagtgaatgtcggatcttggtccgacatggacttataagtgtcagggatggtgataggtggctcggaggcgagggtgaagtgctcctgcttgttgttctatagatagaaccacgatgccttccaaacatcctaacgacctactgagtctgatgtgatatactttgtaggggcccctgatgcacccctagaagtaacactcaccgatgatcattcctcgcttggtccactagaggacgaagaattagcgatagaagaacaatgacactttggaaggaggaaggttaggtgctcgggcacttgggtaccccctcacggccaccccaatggccacatttaatctccacttcccgcacaaaactcaaatgtagtgtatgaaactgagagcacctataggggtgaataggtaatcctgcaaaattagctctaaacaacacaaacttgtttttataaaatatgttagtgaaaactaaaatcaagttaggatgagaagagaggagaaaagataaattttcacttgattgcttctttaagacaagtattaaacttaggaacaatattacaagtgaatatgagaactcaagaagacaataattgtaataagtaaaatggacaagggacacgtcgatttttaccatggttcgaccaatgcatactccacattgtggtgacctcctttggtcaaaggttgcactcaacccatctcaagtgatccaaagaaactttatgccacagttgtcttccttatatcaatatctcgttgtgaggaatcttgtcacgtacatggttcgcattcggtttgccttccaaaaccgggtgtgacaaatctctaaaaattggagtccctcacgccttacacaaatgataacaatcaaattcggagtaaggaggggagtagagacgcacacaagagcacaatgcaacaacaacacacacaaatgtgaagaagagagcgcaacaagaaaacgacagagtagcgactcaagaattgcgctaagatctttctagaacactttggaggcatggtcacgtagtactgaagttgtagtgtgctcaaagtacgcttgggtacttctccaaggcgcctagggggtccttttatagccctatgggacctaggagccgttggagcttcatttggaagctcccagccttccctatctgcaggtgcaccataccatccggtggcgcactggacactgtacagtgcaacggtcaacagatccctgattagtcaatttttgtttcagacgagcaccagactatctgatggagggtaccagactatcctgtgctccatctgacccttggctacggctgacgtggctgatagtcgttggctgtcttcacatgggactttctgggtgggtggcaccggaccatccggtgaattttatccagtggggcctggttgagcccgagagtcgctactttggccgtacgcacaccggactgtccggtgctacctagtccaacacaatttcttccttttgtgccaactttcttttgctcttgctgggctcgacttcatatggtccctagcacttagataaacatgattagtacctaaaacaattgactaagtactagaaacttacctttatcactttgatccatagaggtttgtagtatgtccattttcaagccaaaaagtgttttcccctatattcctcaatatgctttacaaacacctgtgcccatgctcatatgaggagttgttagatcatagtattgtgttgagcatttaatcaccaaaataactagaaatagcccaagggcacatttccctttcagaagcctgagaagtttggaagcatgtgtcgaatcagctcatgatgggtcgcctttcgcacaagtattgtctcgtgttttgtccccacttaaagactataaatcctacagtgggcctgtgggcattgtcagcaccctagtagtgtaccccatgcgctacaataggtaggcacggaagggtaggcaatggaccctagcatcacagagggtcatatctagaagacctaattacaaggattatgaatgcttggagaggaccccttccacgtggctacattggaggctcccaccatgaacatcaagattccatcctacggacgccaccgacaggttgttagcaagaccacatatccctagcggccctgtcctggataggttttgacaatgtcacgtgtctaagggctcctacatgagctagaggccctctgggaggcctcctatctccaccctctacgttatgggggtctaggtgcaccacacatctcagacctagcgtcgctccacccgcggtaggtccgagcatgcaacgtgccccaaggccctaggacgcccctagccaaaggggctccatacatgccacaaagcaccagttgtccccgccatgtgtggtcaaggagttggtggagtcagagagttgttatgctatgtgatgggacatgcatgattgtgcccacaacatgcaccatgttgattgtcaaaccttgacatcctaggtatggcacagatgcaccactatgggtgcatgcacgagcgacatgcaccatgactagtgatgactttgatcgtccacgacgtacatgtgacctcgatcatccacgatgtacaaaaaatgttgctacagggcaaaagaatgacatatacgaaaaacttgactaggaggctaataccacctcatgatattacattaatagaaggttgcgacaacgatccatgaaacccccgaaccgtatcctcccatcactaatagaccgattcaagttgtccactctgcaagggcccacctaggcccaatggtggcacacagtcgagtcgtaactcaagagcgagaaaaagaatgacatatacaccttctacagtataatagacagggtcaaaccactaggctgaccccacatatcttgtaatctcatctcccctagtctataaaagggagagggagacccctttagcggagggactctctcttctcaccaacatacacacatttagccattttcacatccaagcaatacagaccagccactcccgagaggccgagaacgtagggtattacgcactagcgacctgaacctctttaaaacattgtctctcgtgtaccacactcgttcccacactttgccctctctcgttaacctggggatatccgaattaccattgagacctgtcggagtggaaatctccagccgggtggcggagtgcacccgccctaaatcctaagatgaggagggggcctaagcgttttgcttgttagttggatgtagggatgaacacaagaacacacaagggtttagagtggttcgggccgccggagcgtaataccctactccactgtgtgttgtattgcttgagtctaagcctaaagattgagcttgagttgtgtcttgaatcacttaggtctatcttgtaacgtcgcatgcctccccttttatagctgaagggggcatgcacaaaggtactgagccccgacctatgggcccagtgacataatagatatagcacttggagctacaaatgttcgccgctggagcaatcttctcgcgccctgacatccgagatctgcgtatcctcggcgtgcagaggaagcttctcgtataagggatgatgagcacaatgcgctacatggcacgggcgtactgtttgacaatagactggacaggcgcgccgtctgcaggatgaccctgacgccgtctgccagcagagtggacaggacacattaaatgctgagagggcgcatcgtctgtcagcatggtggcaggtcgcgtgtcctctccgcaataaatgcagagaccgcgcgactttagaggccttacgtcagggtccgcctgttggcttatgtcatgggccacaagccatgcggcagcaacgggtcttcgcctgagcggggagcgtaagcacgcagggcaaggcctggacacgtgccagcaccggacccttactcatgtcggggttccccctgtcccgggaccttgctgtggtccggaccttacttggagggacctggggcccatccgagggacccagcatgccttcctgggagtctcggaccgtaaccgagggtccgggttgtacgtacaggggtccggtgttcctccgctgaggtccggacctaatgatgcatcttagggtgcatcatctttcctcgccacatggtgcccctagatctgcccatgtggtggggtcgggtgtcgttcaccgtgcgaccaggagacatcatatgtgtacagtgtctttatacgtacccctgattcagggtaccgacaagacccttgctaaacctaaaaggggttctctctatactccgaattgacacttgttatcacactcctatccaatgttatgtctggtgctactacagactcaccaactagcatttttaaattgcttttcaagttgcatttccttttgtattttttatgagttctcttgggtttacctatcactagttttcgcaagtatgcacaccacatctaactagaatcacctaagtcaaactacccatctcaagtctccctttatactacgactaaaggaaaaaataacgataatatcactgacctaagtgtccaataactttattgacacttagaactagttgttacttaactattttgagtatccatttaaaaaccgaccgttgggtatccatcaacaagggcatgaatgtcgcataagctcaatcgtcctgcaatattatgttctagcttatcttatttctgcaaaaatacacattaatcataataaatcttatgttgttattaatcactagaaccaaacttaggactagatattttttaatctaaagtaactggaagacctaaatattccttttgttttcttatattttgagatctaaaactagatttttcgaatggttaagtatagattgtatcaatgtctaaggtcgttcgatcattttaagttttgaatttcaaaaaaaattctaaaacaatagaacaaatgttcaggattctaaatgtgcttattcgtctatatatggtggttgctttggacttctcgatgggcctgaatctgaccctaaggaaggcctcgattcagcccactaggttcggcagagtttgaagtcgaaggaagaaaacgcagtacatgtacaagacacagatgggcacgctcactccactcgctcgtctcgtctcgtgtcctatggatgcaatgcaagggtatttccagaacacatggcttgcttgtactgggaggaattgggcgcgctgcagggcaggctgcagccagccgagattattgcgagctacgtacagtactctactgtttttaccagtgcaccgtacgcgagggtgtagacgaccaaaggtacggtgtctcccgtacgtgcagcaggatccccacgtttccgacgaagaattttttctctctggtacgtatatttgttgtacgtcgtgcagcctgcagggcgtttgaagacttgttgggctggctcgcatcgcactcgcacccaatcaaaaagaggacgcttccgacgcagcgaaggcacatgcatccagctccagcctcttcgtcgtgaaaaacgtaaaagatcacactcatcgctatcgttactagaagaaaaaaagggtgaatagaaaagaaatcaggaaagtgaccgtttcttttcccttccattattctcttggtgatgaaacacgaccggttctctagcctcgtgcagtcgtggtgcatcgcggccggtttatttggagttgggcgtttgaccaccgagaagtggactgtggccaaaccagctgagcagaggccaccactgacatcgagcatcacgcataataataatgcattaattaatgcccacctgtgggaggctgggggctggggctggggggatggtgctcggctgaagtgaggccggctccaatccatcacagcagcaggccagcagctagccatccaaggtgagtgagtggcgtcttcgctttgtagctgcaccccgccgcagcggcgagtgctcctgtatgaatctaacggtgctttggccgcatcctctccacctccacatccacatccacatccacatccgtggtggatcctagttagttcggtcctccccctccatgcctcccgacgaaaaaagcagcgtgtggtggcagtgacgaccacagcgaaaaaagcggcaattgaaggcgatggtgtggcctggagctggagtgggcgctcatgcaaccgccgccaagtgctgctgccgcaaccgcagtaggccaacgatgtggtgtcgaggcggattcagcatataaaattcacttttatcattgaaattgaattacattctaataataatttagggatatatcaattaagttaatttggttttatgcaaaatatatttgtatattattattagcaagatgtccgaaatctttatatgctatattttttctataaaagagtaagatgaaaagtgtcatgtaagttacaaagtataaacaaattttactaattcataaaatcatttcccaccctccaccctatgaatttgagatatgcttatatctgaactttggaaagtgatggaatgtcaaattccaaactaaataagttattttattgagtgaattctaattcctctaaaatgaagggatccaaacgccacgtacagcgatttcaccccttttctttacttactataaatcactagtttcgacagttattatgtgtcatcacttttacagaagcccctcacatttctttgaaatcaacccaaaatcccaccgtcactcatgtgtcacgcgcggagcgtatatctatttttacccaacgtctcgttttacaaccagataagataaatcttatctccgcacaaccagccatacaatcaccatgagtgtgcgcaaaagcctgtatatatgattttattgtcacatctcgtctaataagataagtattatcttttgcatacggaaccaataatgtaaccactatgagcgtttatattaactctcaacttctatctatatattctttgttatttatttttatgtaaccgttatgtactaacattttattaaatatttatgtgccctcgtaaacacgggtattgtatctagtgtacctaataaattcgctcgccgtggccacaaaatcacgacaacactaaaatacgtacacttggaggtgaagtcaccaacaaaacaagcgtctccctccaccggtccaccccccatctggctctctgcttctgcacctgcgtgtgctagcgcgagcgcgtgcgtcccttccccggcacgagcggcgcacaccgtcacatccgcgctccgttcgccttccagaaaatttaaaccccagcggagccggccacggtcagtcagccgccacacggtctccgacgcgctgcccgctcgcctgccaaacccccaccccctcggcggcgatgctgacacgtcgccgtagcaaccacccgggctgctccttccccctcccgttcctcgtctgcggcctgctcctcgctgcggccgtcgcattttccccagctgcggccgccgaagcagctgaaggcggcgctgggcacgagggccgcgcggggaaaccggaggtagaggccgaggcggaggcgcgcggggatggggttgccgtggcggaagccggcggcgaggtggtggctcagggcaatgccacggaggccaaggagggcagccttgccgacatgatcgaccgcgcgctggagaaggagttcccggagtccgagggcgagcagggcggtggaggtgcgtggatctggccaactccagggatgcatcgtcccgttcgggcgcgggatctggttctgggggcggtggcgtgtgtcggtggccgtactgtttagatctcggcctcggtggttggagcgtgtggggacgttgagaatggaggtcctatgtctgaacttggagttgcttgtgctaatctgagctctggttttgcagagaccgaccctggcagcttcaacaacacggtagctgagaagcaggtgagttcattgcgccattttgtttgtgtgctgcccctttgttggcagggttcatgattctgtgattcaacattgggtctgccacaactaggttttgggtgatttgcttaccaattccatgttggaatttgtgaatgaagggaaattcgcttttgaactggcctgtgcctgattcctacacttgcgaatctgctagtatgtagttatgttgccttgacccagattgtatttaggtcctgtttgtttaccctctagattatataatccagcttaaataagttgagagttaaacaaacaacacaggtggattatgtaatctagatacctagattataataatccataagcaggtcaatagatgcttatatagtccataagctgaattatataatcctagcattcaacgacccatccatatgtcatcatagtatagctattgggccaatgggccctttgactttatatggtcattttgctttatgttatttgttcggcattttcctagtgctgatgagggaaaccaatgtcttggctgttgtttattttgtgctatgcctggcaataataagtatgactatatgtttgttgtgcacaattgcacatgagaggtgattagcatgggcatgactatttttattgtacccattagctactactgaagacaattataaattgtttgtcgtgttcctaagatgctacagaaaattctaatttggacatcctagttctgtttccctactggagttcatgtttgatctacatggttgctacatcgagtagttcatttcaaaggttcagcttcccattagtatgtttgttacttcgtcatttcttcataatactccttctggttataaaaacatattgtctgggacaagagttagtcaaaccttaaaactacaaacatcactaacttttaaattatttagatcgagaacatgaaagtgcacagaattgattgaaaatacttgcaaaatctcagaaatttgaaggattataagaatgtcattctaaaagaaattaatgataaaagatatgtgtcgagggctttgcaaactcagatgtgacaattatttttgtaccatagtgattatatattttaaatggaagcttataataacctgcatgatacaccttgggttcaagaaacaagatatcacaacttctattttctcagataatatagtggtctgtggtcctttatttggatattggaaaacttgaagcacatatatgtaatgcatcgttgtgtttacttgtactttgaaaatttggtgcttgcacatcacagatatgcaatgcaaactgctcatcttgttccttctactcgtaccagggagttcttgaaactgtagctagaagagtaacaaagaagaatgaaaccaaagataacaagtatgctgcaaatccagtcttcatagtttctgttagatgaaattaaccttagattcagaacgtgtaagagtttaaagttgtcattctgtttcatcaggtcatttccttttaaggaggttttcttggatcgaactgagcaagaggatgttcccacgttgatagatcggaaggtacaatcacatcctctggatggaattttctgtcaagtcactgtgcatgtgccatacatgttggcataatgttgtggacatgttatgacttatgaccattttttataacagttttgtgttaatccaattttgaccccaggataatgtttttatcatctcaaacccaaagtcaaaataccctgtgctgcagctggaccttaggtatgttactcagtgttcagttatttgatgtatcggatgaaaaaaaatcttttttgcatggaaacttatctgttgaatgtatattattgtaggttgatatcagatcttgttgttgttatcgtatccgctacatgtggtggaattgcctttgcttgccttgggcaaccggtgagtacctgtacttttatttcctctaatttttttatcatcattaacagctggaaacataatttgtgtattcaaaatgttgtatttttaaggttaaggtacatgaacctacaattcaaagtatattgcaggtgattacaggttatctacttgcaggatctataattgggcctggaggttttagctttgtcaatgaaatggtgcaagtaaggtgcttccacctttgtgggttgctttttctaatgtgttctctttatggcctgcatgtttgacatggatacacatgcccttgaaaacctctgtacaagagacctgccctgtagacttgtgtagaaacatatgtttcctggctaatgtctcctgccatcatatttctaacatgatgtgtgtgcgcgcacgatcagttcttttatatgtatttatatatttacagcatggcttagtttatttgtacctggataaatttggtctactgtttcattcattctaaaatcaactgtccttacaattatcttgcttatgcgtttcaagacctactgatttatgttattctgtgctgcctactatgcaatcacaatgtcgataagatgtacataagtagtccatgtttttaagtatggcattttcttatattgcatgctcagttctacatgtattttatatatactacagcatggcttagtttattttctacctgtataacttcactccactatttcatacattctaaaatcaactatccttacaattatcttgcttatgagttttgagacctactactgatttctgttattctgtgctgcctactatgcaatggaaatgtcgataagatgtatataagtagtccatgttttcaagtgtggcattttcttatattccactgtttcttttccaggttgaaacggtagcccagtttggtgtgatatttctcctgtttgcattgggacttgagttttctactgcaaaagtattttacctttaccatttcttaccatttcttccctcattcagttggcaacaccatctgtgatctgaagctaatatactgttgtttttacattgcctcagcttcgagttgttcgtgctgttgctgttctcggaggattgctccaaattatgttgttcatgtttctttgtggtattttggctaccgtgagtttcgtctctgttgtccgcattatgatatatactttggagctgtcttattacgttgtgtaaacctagttgtcactcttctcgaggggaacattgagatcttttattctatgtcctgacatcaaataatttaattgtttcataaaacattgatcagaataacaagatttgatgcatctgtaactcatttgaacatgcggccaatataagtgactagaagggattatgcagtagaagtaaccaagtcagcttcctggagcttgacctgccagtgttttgtgaaaaaatatttgatgcattttactaagccagaggggtgaaaacgattgccggtcggtcggaaatttacgcggtttcataattaatctacttactgacgactgacgttgatagatatttgaaattcaaaatttaaaaacggtaattttcggaaacgatacagttacgagacaccggttacaggaatttcagttacggttttcagccattgccagctattttatttgtttctaggttgtatggccttgtcttgattcataagagcatggttgacagatcttttatgctgtttaatgcagctatgtggaggcaaaactaaagaaggtgtttttgttggtgttcttctctccatgtcttcaacagctgtcgtaagtatctggtcagggtcaacaggtggccagtggcctatcagagaaatcaatatttttcagtgtcaataactcttgccattatgattatttggtccagtagcctggctctcttcctccctctctctgtcgctcacacatttgcagacacacaaaatgtttggtgctgcattttgtgtttgaaattatctcgaagcaagtgaatgcatgaatacataattgtttgtgaatgactaacattctttgctgtgctgtagtgtggttctcacaattgcatgcaccttttgttgtacacaaactcattttagtttctgagaacaacctttttattatttgaaaatataaaaaatgccagtaggggcttcatctgctgttcatatatatgaaaaatatttgcctgtaccacaaatggagtcagtacatcttgattgagaaatttagcacctgatgtttgaaacctgaatatagtatgcttggatgttttgtcacttgcaactgcaatacgctcattatttatgtcattgtgtagtcattcgtgatgctgctggtgtgccacctggttatctgtttattcaataatggtgagttttgtttatgaaggttttaaagtttctgatggaaagaaatagtatcaatgctcttcatggccaggttacagtcgggacacttatattgcaggtctgtctactttctttatcttttgtgtgcaagatgcatctgtgtacatgcatctagtgtctgccattgttaagaaaagttgatccaaggcacttttctttttccttttttataaattaagaaatatatctcagttgtgtgacatcctatttctcctgccccccaggattgtgctgttggcctgctgtttgcgcttcttccaattttgagtggtacatctggccttcttcacggagttgcatcaatgatgaagtcgtaagtgcagcatttctttcccccttttgccctgaagcctgaagtactttggtaacctttatattgcaaatttgttttacaatgagttgaatgttttgttggcttatccacttgatacaattcttgtacactaagttcatgttttcttgacatggtggcaagtccagttgatacaacattgctaaccccaaggcccaaagtcaccctaatagtttatgatctctttattatcttgtatttaatattactaattgtattatccattatattttgtttgctagcctataaaagtattctagtatatagtcagttgtgaaattaatttttgatacaaaacttctcaggctggtggtattgataacattcctgaccattctctctatcctctcccgtaccggcgttccttggtttcttaaactgatgataagtctgtcatcacaggtaaagtctgattttataagaaagcagtgcacctttttgagcaatttgagttttgatcttgtagaacattcttaccagcaatcttatgttctggttgctctgcatgtcacacagacaaatgaactatatcagctggcagcagttgcattctgcttgttatttgcttgggtgagtttctactgctcttatattggtatgttgtgaaaactgtgcagtaacatagaaaaggggtcttatttttgtacagcgcaagcgtttgcatgtgctaaaagcctaaaacctgctaaaagttatgttttaaacgaatcaataaaggggtattgcaaatgcttacttcatacataaaacatatataaaggaacacaatacttactttcctgaacttatctttaccaattgaacttttctagattttgatttagcttatggacctatatttctttactttatcatcaaaactgtatttgttaaagacttaaaggtatgcagatgagcagatcttaaaaattcttgtcattctcatgtttacatccttctatgatgcagtgtagtgataagttgggcctgagtctcgagttgggttcttttgcagctggagtaatgatatcaacaacagaccttgcacaacatactcttgaacaagtaactttttacatgtaccttgcatgttttttctgtcccctttccaggaaaaggggggaattactatctactaccccctctttcaaaccacaggccactttagctttgttctaagtcaaacatctttgactttggccaaatattaaaaatacatcaacaaatgcacaaggcacgtttcatggataatttaatgaaatcaatttgatgttggagcattttctgtaaaccttgtgaaagttagagaagtttgacttatgagattgctgaattgatctataatttggaacggagaaagtctttagtttgatctttattttatgcttgagcaaactcatagctagactcttgtagttagtaattcattatattgttctcttatttcaggcttgttctttctgcagatcgaacccatccgcaactttttcgctgctcttttccttgccagcattgggatgctaattaatgtccatttcttgtggaaccatgtggatatactccttgcagcagtaattttggtgatcaccgtaaagacctttattgttgctattgttgtaaaagggtttgggtatagcaacaaaacatctcttcttgtaagtcctttttcatatcttccttaatgcactcacatctgccagtgctcataaaatcacattaaccgtgtttgtccccacaggtcggcatgtcacttgcacaaataggagagtttgcttttgttctcttaagccgtgcttcaagtattcatctaatcgaggttattttcttgatattatcttccattttttgtgttatgccacacgcaagagccatggttgtgctgacaatttaaaactatggggaccttgttattcttcagcataaagtacatgtaaatgcatagttttcagtgatgctgccttgttattcttgtaagcactgatatatcataatttaactttagatgtcaaagtttaacttcagcatgtctagcaaagcatgcaaatctttttgttaggagaggaaacctaaaccctaactagggttgggatgatttattaatagatagaaatgtatatggacgtggcctaagcccattacagttgagacacatatgtctaacaccctccgcagtcgcaactctaggcattacagatgttgagactggaccaaaactctgagaacactgtagagggatgccccttggtggagaataccatgttaggaggggaaaccctaactgggcctgggatgctctattaatagatagaaatgtatatgggctggacctaagcccattacagttgagacacccacttatatctaacacttttgatgctatcagtattaagtattaaatatatattatacatcccagtgtagtctgttggcactagttcccctttttagtcgcccaagaatccctagtactactattttcaagttaatgggtgacatctgataacttgtatttgattttttacagggcaagctatacctgcttcttcttggaaccactgcacttagtttggtatttgcctccattccttttaagctattcattttatctagataagcattgccattcaaaatttcagtgcgaacgagatcgatttttttttatttgtaatgaatatttcattcaggagagtttttttatttgtatgtaaaatactactatgctaaagagtcaatttcatgcagtgaggcaagaggtctcagaaataacaatttcttgtcactttaggcaagaactttatacttcggacactggttttaatatgttttatgggggcgtttggtgtacagccagctgccactgcagccagcaccacaaatagtttgcagtcttgtccacgaatcatttccttatggagtgtttggtttgaccgtttgaggaatgggctagtctatcattttctcactcacttttttggtttggtttgtgtaatgtaatgagttgatccgttaccaccttattcctcacagttagtactaatatgaggaatgagattatgtcaccaaatttgaggaatgaactcatgatgtaccacctcattttggatggagtgattacttacccccttagtgtttggttctgagccaaatggtgcagaaaagtgagtgacggaaaaacttgccttccgaattgataaatctatagatccaactattacaaaccgcatgatccaagcaacatgaatgaggtaaactgatccacaggggttcatcagtcatctcacttgtcccatgggttggggtcacaaaatgtctgagcaaccataaaagaaaactaagcagaagctaaggggcatcttgaaataatttcacatgtctaatcgacaatttgtgaatagcacccttcttagtggcgttgccgaaaaatcttgagactaatctcttgtcttgtcttttgtcatgccttcatcctggcttgctgttcatccgatgaccgagtttcatgaaattaatatggcaactgactcttgtgtgtacctttgcaggtgacaacccctctgctattcaaaatgatccctgcaatggtccacctcggggttcttttgagatggttttctgtcgataccaatcaggtggaggtacacgatcataccagttgagttcattgatggattgctttgctctagaatgtttgccaatcaattcatcggttcttccttttcagctgggcctgaaaaatgatgtcctccgcatcgatagcggcaagcgcataaatctgatagtccaaggctcacatgactcatgacacatttgacacactgcaagctactttttgtatggcttaagtttacaagctctgtaaagtgttttcacctgtactgaagagtttctagcagatatacgagggtggaggcaagagaactcaactcagatcttgctcctagggcaagatcaatcctcccccgtcatgacggctgcaagggcaaaatcgggttttgccgtttttgagagcagtgtgtcttggatgattggtgcagtgagtggctgtcgaccccaaatgagggtctcgtgtaacatatgaatgtatggtgattaattaattggattagcatgataggatgtaggcctgatcctcagtaaaggttaagcccttgtgttctttcaccaaagttgtgtatcctcacaacacgaaagtgtgtacgatatccatcagatcacgaattttgttatgtagctatatatgtcagtttcttaacatgtccaagttcatgagttttttttttctcacgggaagcttttgagtaacctttgttcagatatcactttgttggatcgagtccaggatctcaatgattggtgtgtttcattgaatttattcactttttattataccatgttgcatggtcgcctccgatatggtgaattaccagctgcagtgcatgcgttctaggcgattcacgtgtatgtattaggaatttttaaatccgtatcctatttgcatcattattcagttttcttcaccatcattactcagttttgttcctttctagtttactacccatcagatctagctccggcagccccgtggccgtggccctccgcccaaacccgctcatagccaaaagttacatttttagcttctgtcgtaccttctctcagctcgaattccgcagcttctgcgatgatggagcggccgggtggatggatatttggtaggagctgtttttcagcttgtgaagccgacaacaatccctaccaaccaggctcttggtacacgacgcgacagggtcacaagaagttaccggctcagaacaagttcatcgagtctcgatgcctgttgtttgaaagtcgttctccctccatcccaagacgtgagcctcattttgacctcttaagtcgtggcatacattgtacatattacatctaccacgacattatgcacacagcaccgcggacatatagacttcaatgtgtacagagttcacatgccacgagcactgcttatccgcgcttggtaaccgttgacgttgcatcgctggtaatgtacacgctgcatcccagcacggccgcctggaatagaagcattttcaggctgaccagctgctagctgatggtaaacaatggcaagtgaggggctactgctgcttcctgctgcgtcgctccagtctgcttctgatggtcgatgttgaagtacatgtctctgccgaactatctacttgcctgggcctgcctgttcatgacgtcatggtagtatagaaggacacacatcggctgtccgactatactgaagaagaaccaaaatatcatgttgcccacctgccaaataagaagatgatggttaggtagtggcaagaggtaatggggaaaaaaagacataattgacacagcgtaccattacatgcttgaacgtagcatggagatatcttgtcaagaataccaagggtatctgagtcagacatcaacgagtgtcagcctatgtgaaaacagtggaaggtacattgtatccaagatgtagtattgttcttatggatgtaatgatggaatcaaaatgtaagagaatagacactgatggactcaaaagaaaaggcagggataattacaagtcattctagtttttctagattcgtagcttttgctacgcatctagataatgtccagatatataactcttagcattatctagaaaagccaagtcaggatgacttacagttcgaaatggaggtagtagttattatattattactacttctataactgaaaccatgatcctattttctagataggtaacatttggtatgcatctagatatacacaatgtctagatatataactattataatctagatatatacctagtataatgtaactagaaaagccaagccagaaaagacttataattcggaatggagggagtagttatattagtgtcatttctatacctgaaacatgatcccagaaaatgcccagaatttgaaaatgtggcaaggcaccgcaatacatatctgtgaattcacaatgtaaaaatggtgatgatacattggcacgtaaggtcaaacatattgttggtaatgtgctgagtggaattcaaacaacaacatgtcttaggaaaaacagaaattgaaccgatcatgaaagacttctgaagaacttaagtacctcatgaaatacagctgaaaccagaaacgagattagaatagctacaccctgcagtgtagatacaatacaaatttgagaagtaggtagtgaaaatcatgtcagttctgcaaaaatgaaaggaccaacaaaattttatgtatgtccatgtattcacattgtttaatttacttttggcagtaagcagaaggcagcattttgttgccaagtctagatatcctttgtttttatttaaaatctttatccaagaacagtaaagtttcagccactataaaatccaagcatagtaaatctttatctaagaagaacttcaaatcttaatttacattaccaaattgacttactatgcaaataatattgaccagtactgttctgattttctcacaacagtttcagacacttgttcagttgtcttcattattattatgacaaattgacaattgagtgctaacactctgtccaactctgcttccccattttctaaagaacatcatttgtatattgtgaattctatattgcatcgatgtggaaagtaaagatattactttgggactgttttgcagagacgaattgagtaactgttccaaactaatctgcatttggagaattcaaaagcaaagaacaaatgtagagttttgtacacatatagaagcaattaccctggaaaagcctttccttatacatggaaaatatatgtgtctgatgatccacttatgaacaggctgacaaaagatagactaattgtcagttatttgaaagatattattatacaaatatctcaagctcagtgacagaagttaagtcttaactaaatagaagagtaccactaccatcttaactgtccttagttaagtaacaaagtctcaactaaataaaagggtatagaatctgaatatggaagtaacaaaaagattaccatgttccacatcctccagtactgaggtaaagccccaaaataccatcgcatttaagtacatgagaatataattgatgtcagtcctatttaaagttctcacttcaaaagaaacgaactcaattttaacaggcatctcacctcttcaacagttttggcattccaccagtccttatagaattcacggtcaccgaaacagaggagttcagctacaatgttcagcctgcaaccaaccaaaagagcaaacaagaatgccatggaaaatggaaatcaaagtcccatgcaggtcaaaacccaattaacctgttatataaaccaatcactgccgcacaaatttaaggtactgttgaactgaagcaagatactaaccataaatgaaaaaagcaatagaacatgcaaagccatacatataatgttggcactgagagttttaagactctttctatagcattcaaaaaattccctttcagtggatgtttggaattcttcacaattgggtttatatactgcaaaatagaagagaaattggtaatttaatccaaagttatgtataaatacaagttacttaaggaatataggaggctcacttgctcaattatgaagcccatcaagcctgtaaaaaccacgcactttatgagttgctgggtcacccaaccctttctaatacatgtagtttgaggataagttggctgcataacatgccaaagtgacatcaggaaattcatgttgtcactggcataactagatagacgcgatgaagaaaagcagagtgtagacattaaaaacaaaaacggggcattggtccaataatagtacctggtaacaaagtgttggggccaacataaagtacactagacttttaaaggttggatctttcatattctcaggatcgacataatttccatatgcagcaccctaaaaataagaatatagcaatagtggttatttgcatgaaaatgaaaatgaagggatataatcatatgcctaccgttgcctgaagttagaatgagggaaaccctaaccctaattagggttgggaatgcattgatataacagggttaggtggaccaaggcccattacaatagaggtatacactaacagttaagctaacacatgagagtatatatgatcagcccatgtaacaaaaacactgtatgagaagttaagaacaatttttttactcccttgatggtaacgtatattgattggcaccacatttcatcctatgcaaaaattgaaactagatataagaaattcatgaaatgaaactggaaaagaagtttaggccatgtttgtttgagcctctggacagcttctaagcctgaaaagccagaagctcaaacaaagtagcttttttggtttagctaccagaaagccaaaagctcaaaaaaatgaatttaatggcaagctgaaaagtatagttttgtagacttcctgagtttaataagctaataaaatcatcaaaaagctaccattggcttctcaggatcaaaagcccaacaacagcttatcaaaaaagccccaaaagctgaaccccaaacaaacatgcccttaaacaagaagtgggagatattctagcttcagaaaaaaattggccaccaaaaggagttttaagaaaagtttgaacgtcaacaaatcaattctgagaaatgggcaacatgttaacaaaatatttgaactgattcagattaacatgtcattgcattaccttttcagtacttttggacaatacccttatatcataatttgtatgtgcataagagacaagcttcatccacatgatgctcgcaagaaacattagcacaaatccagatagtactgctgagtcacacctgaaatttttcggaatatgactgaactgataatccataattgatgcatgggacactatcttttcaagtaacatttcttggcaattataacaaacttaaactaaacaacataaggcatcaaccatacaacattcttaactcttgcagtctcactgacaatataatcaatgaaaaggtaacttgctcctaatgcctctttttgagagataacaattgactcaaccaaagtctactacttgcacatcaacatcagaaatactacagtttgtttattcaatttgcaagcatgtgaacaaatatatccaatttttgttgtacaatggaaagatcagcttcatgttaggaaaggggttacaagctagaagctacatgaaagaaacaaaatatctgcataataaaatgtgtatcaatattgatggactaacaaatcttccctattagatgcagtcagtgaacagatcaagacagagtaagatagtaaggatttcttctactagagataaatgaacatttgcaatagatttttatcaccagatacatttttttcttgaatatgctggagagttgtgtttctttgtattatagtgtggagtcaccagatacaattaaataaaagtgttatgtagctacctttttatccacccaatttgcatagtatagtaggtatcttgaagggaaagactaaatgtttggggcacaataatgtagttggccaccagaccacgaagtacagcaaattacgaacaagattaattgaatgtattccataccatgaaatactagagctcaacgaatgtcaaaagcagatgcatccaaacaaactgcaaagcagaaagaaatgcttacttaagagtcacaacaactggatagacaatggcagatgttgtaataatgatatggagtagaataaccacctgcaagaggtgtatagaagtcataaacgataaatggcacctggaagatgcagaatagaggactgtctagttttacacctaattcaatcctcaacacttatacctaagaaataacaaaagagaacttctctacaaaatactacgcaatcctgtgagtcaaacttacatgttcaccaatgagctttcttgtgatcagcttctcagccatgagtgcaactagtgggaaaactggtagagtgaggctgaaattgacagattgattactccacagttcttatttgaaacccatctgaattaaaattgacaacaatttctaccagcacattagaaggggccagtcacccagcgatcttgcactaaaccaaaatccagctcttatcaacaggccatactgcagcagccaatttaaataaaacacggaatgtgtcagatttacactagacaaatgcgcagaaagaagaccagatgtatttcagaaggagatggattgagggatctgtaaatgaaggtgaggaaaatgaaaaaaaagaaagtaataaaccttcattaaattctcaataatgagtctgctgttcactgcgatcagaacaacaatgcatagattcagaagaccagcatggctctgcaatcaggagaagtgcttagtttcaagacttcaattctccagggcaaccaataaatacggtttgcaaaaaataaggatgatctcagttgaagtacaagataaaatgatatatggaatactgatatattataatcaagttagcatggactcaattatcaaagcgttgtccactgtgtaatcccaggaaccatgtaggaggcatgtgatgtataaatattcaggcaactgaggattatttatcatccaaataagcactcctaccttcaaaacagatttagagtatgtgcagaaacaacaaagtctaataaaagtatcactagaaaattacgtctcacgtgtttctgctgtgatttgagccctattaagattacactgggaaaagggctccgagagtagcaaacaaaaataatgtcaatgacaataaaaatagtctaataatatacctattcaaaaatggagggctaaccagttaaaacttacaagtggtccaatacagttctatgtaggtgcacagttatatggtcctcaacaagaagcaatgcctcaagcaggaaagccaaggtgtacaaacaatgtaacacgcattgtagttagaaaagtcagcattaataatactgggggcactgcaggtgctgtcccaacaactgtccacatcactatagtaagtaccgccaacaatgaattcaatgactcattcgctcatccagtcatccgtttcgacaagccaaagctcctccagtggtaacggttacgctcgttgtttgctgcttcagccggccgatgccaaattctgcgtggcatgcatctggcacccgcacaccggcactggcccccctgatcccaaaacaagtaaacaccgacctcaatcgcagcagcatatgccccccacgaaacgaattgtgcccattcgagtacacgcgcacaatctatccacgattccgaagcccaaggcccacaataaaacatccgtgcgcgcgagatggcaaccggcagtgttaagctaccggtagcacaaagtgtgatttgaacacacacacacaccaaccaaaaaaaaaacagaggcagagttgactggaagcaacaaacaatttgcaggattttgcaactggcgtggatcgaagcacaagtgcggggatcaaacaatcgcttacaaacagcgagcctaaaattcgcgtatcctcacctgccggaagatggcgtcagagctgagggggctctccttgacgcggcggtgggcgggcgccgacgcgcggtagtatagcatctcgtgctgctgctgctcctgcggcggcggattcgtcggcgattgcggctcgccgttctcccgcaagcctcccgaggaatcgccggcaaggtcgccggcgtcggctgagggggcgcggcggaggcgaagggaggacgagtcgcccgcgtcgcggccagggccggcgcgatcggaggcggcaggcatggaggggggcggggccatgcgaggaaggttccagaaggtgagggagcggggctttgggggtgcgatactttggggcagcggtggcggtggcgaccttggtgcctggtggggaggggaggagccgaggtgcgtgttttgatgcgggtgttgggccgcgcggcggctgacgcacaaaagcgcgggggcgagatggcggcctcgaaaaggggacacgtggacgggcgagcttgccaggcgtcctctccgtcaccggcttggttggaagggtccggtcgggcgagtcgtcgcaggcagcagtcgggagcgagcctgtctgtctcgtttgatcgatcgttccagccgcgttgaggctgaggatggcacgtccctcttgtggaacgtacctaaagatgggagaaaatcaaacttggggatggagatttgtgtgctccggaaaatccacacctgtaagcaccacctatatcattagtaaacgtgcctcgtacaaaatttaacatattttaaaatcaggattcctacaaacattcaacacgagttgttctaaaacttacatgagcgagagtgaaccgttgatcagggttatttatgtagaacatgtttagttgccatcattaaagagtgtttcggaacacatttttttaaatatcacagaatagaaaatgtcatggcgtaatcttattctttttattatattattatattaaagtactggtttcgatggtcgtcctacatcatatttttaaaaaacatcatcatatttctttataaactaacatgtggttctctttttcatcaatccgtagtacgcacgcacacaacaggcttcgctcagccgtgcgacatccgtggtgtctcgccggttgggtttatcgtcttccaacgactgcacgtaccctccacgcacaacgcggagcctactccagactcatcgtgctctgacgccccacgatctcccaatggttgcgagaaacctccatgcacaacgcagagtctaccgtgaacccttcgctcgcggaccgtccggtgaaatccagtctagcccaagtttggctcttgagccaaactccttcacttcttttttactctctttgtaatgattcctactacttagacaaacatagttagcaacaaaaaaattgactaagagctagaatcatacctttatcactttatttcaaaatagtttgcaatatgctcaagctaagtccaaataatgccactttactttcacaaacaagttagtagccaaacaaaggtacaagaaacaaaatatagtgtaagtgcacttattcaaatacttaaaccttctgtttttatagttttacccaaggttacacttttttgtcttccaatccaactcattttggacttcacatattcaattttcttgatttaaacctatgctcatgctcatatgaacaatgttagttcaaaatgatgtgttgatcatttaatcaccaaaacaattagaaattgtccaagggcacatttccctttcaatctccctcttttggcgatttatgccaacacatctaaagcaactcaaagctactaacataaccaaatatgagccaacttttgcaagttgaagtcaaatcaaacatcaattgaatatgtataggatttgacatatgtggatcattttgccaccactcgttttgaattttgcaatcaaactcatttttctcacttttaagtcaaaaactcttttggttttgcaactcaaacaatttttagaaattagttttgatcaagtgccaaaaactcccccttttccataataaagtattctcccccataagagtagttttgcaataagagagctcctctttgcaatcaagagggtcagaacggagttgagtcggacttggcttactcttgttgtgaacgtcctagcttctcctccttaacatgttggcctttcccaagttcttgctagcccactctaaggttcctaaacatcaaaagattcatgacaccaagcataagctctaaaacactattgactaggttagaactaacctggagatttagttgttgtgcacctgctcgtgttgccggtccatatattgttttgtatggaagtgatgtcctcatcaaactgggatcgccaccacctagcagaaactaggtccctctagggtggtctcaaggactccgtcttcatcgacattttcccttccacggtggttgtcgaaggcatgcgccctttcgttgggtgttaaggcggtgcctttactccgtggcataggcccactcaagggtgtctttgcttgttgaagatcccttgtctgctggtgccttcgctatcagtgagccccctcttgcgcgggtctttcgtaaagtcattgttagtggagaccatcgaagggaccttcgttggtgcgggtctggcgaagttctctaacgcgtggaacactacacttaaacatgggttagttccaacctacgcagggctgatcgaggttggcttcggccttcgctccaacaatcaccgcactccaatcgccaccgagccatatagatgttgattgccaagagtaacaagcactagactttcacttggccaagataagcctaatgtgggtggtggatgcacacaaatctctctttagacactaatgaggttgctaatcacaagatccacatttctctaatctcctcacggtgctaagcgttttcgtttctctcaaaaggttgctttagctgttgaaaggggcaagacatcttaagaagcaatggacacatcctgtgctactgcaaactgtgcaaggcatgctttatctattttttgtgtttccttccaaattttgtgtgggctctcttggattacctgtcactagtatttttctaagtgcataccacacacataactagactcgtatgtgtcaagttacccatctcatgccatttttatagtatgactaaaacaaaataaatgtcctttcactactctaagcagtggcgtaggcgtgtagctagagggtgagctgggtggaccgtcgcataccttataggccgaccaccagaccaccagacacagtctatagaagcctaataaaaaaatgcgacatcagcttgacttacagcatcggcaaaacaaaaaatatcattgcagatcgttaggtcatctggctcctatggttctgccagctgacctaatgagagatcgcagccacatgttgtgtgccaccacaacaccgcccctgtcgctggtgagcgtcggttgggcacgtcacatctaactttcctctggcctacgtgtagagcctcagacctcagccagagaaggtaaattttttcctcagacctcaatcagagtgtcgtcgaaatgcagaaaaatgaatggcttgaccctaaaattggactttgaaaaggcttgtgataaagtaaaatggccatttctccaacaggttatgcatatgaagggtttctcactgaaatggtgtgtgtgggggttcaatcgatgaagttggtggttaaaattaatgatgaagttggtcctttctttaatactcacaagggacattgacaaggtgatcctctttctccgattattttcaatatagttgaggatatgttggctatactcctctcaagagccaaggcaaataatcaatttgtaggtgtggttcctcatctagtggaggagggactttctatcctccaatatgcggatgataccattgttttaatgaatcatagcttggaacatgcgcgtaacgtaaaacttctcttgaccgcttttgaacaaatgccagttttgaaaatcaactttcataagagtgagctcatttgttatggtttagctaaggactatgaacaatgttactcttgtatttttggttgttgaatcggtccattaccttttaaataccttgggattcccatgatgcatcacagactacgcattagtgagtgacagtgtgtcattgatagattcgaaaaagattaaattcttggaaaggtaaattactttcttctggcggtcacataatgctccttatgttatccgcttctgattcatctgccggcaagagttttaggaaaactagatgccatccggttccgattctaatggcaaagcggacattttaaaaagaaatatatattgacaaaatggaagctcatttgtcaacctaaggaggttggtggattgggggtagccaatttagccactaagaacattttcttactcggcaagtggctctttaagcttctgaatgaagatgatacatggcagcgaattcttaaaaaaatatctaggattcaaatcacttactcaagttaggagaaggtatgtagactcacttttttggtctgactcatgaatgtcaaagaagaattcttgagatgggggaggttttgatcaggtgatgggtaagcaaccagattttgggacgacggatgaatcttagataaaccgcttaaagaccatttttcgaatctttttaatattgtgcataaaaagaatgctttagtcagcgatggaatgaaagagaatatactcaacttatcatttcgtcgagctaccgttggggtaaaacatattgggttccagaacttatcaaacttattggcaactgccggtaccctgaaacaggggtaccctttactgcagtatgaagacgcgatacccacgtggctatctctagtcgcatggtgagcagcacccgatcccaccacatggaaggctccgaggccgccacgtggccagaaaagacgatatactccaaggtatcaacagtgggtctggatccccataggaaagcgtcggacccctgtatatacagaccggacctccgggtaaggtccaggacctccacgggcacaaaccgaacccctaggatgggttttggacccctctatgtggggttcgggccactcacaacagggtctcgggattctgggacaaagaatacccaggtattaatcaaggccaggcggcggtccggagctgacatgtgtccggaccataccacatacacttctgctccccgctcaggcggagccccgatgctgccatgtggcatggtgcgcgtgacgtaagccaacgggtggagcctgacgtaaggcctctgggctgcgcggtctctgcatttattgcgaacaaggcgcgccgcctgtccattccactggcaggcgatgtgtcgcctcggcatttaatgagccctgtctattccactggcaggcgatgtgtcacctccgcatttaatgagacctgtccattctgcggcaagcgacaaccagtccattccgcaagcggcgtgcctgtccattccactgacaggcagtacgcccatgctgtcgcgtgcactacacccatcattactcgtacgtgacgaaggaagcagccgcatcatatcagcactgcatggactatgaacaacagggttgtaacatcccaaaatttcaacccaaggtttggaaccctaatctcctaaccccccttatttttatctctccctaaactccacctcttaggtcatctcaccatatgcatacactttgattgttagaagcacctcacatagattatttttaacacctaagattatttagcaaattgttgttcaaaagaaaaggagataaaaagaaatagaaataaaaaataagaatgagaaatagaaaatataaatagaaaaaggaaaaactctccccctcggctgggccgttttccggcccaagccacttccccccccctctcgcgcccgctcccccctctccctctcgcggcccaagcggcccagcttcgcgcgcccgcgcctgaaagccgggccccacccgtcagctgctcctcccctctccctctcgcgtcgctctcccgctggcagcccggatccgctcgtcagacctctcgtctcgcccatgtcttcaccggcgcgttcgccgccaaccaccgcctgccccgtctccacgccattaacacgctcactagctcggttggcgccatgcgcccccgctcactgtgcccgagtcgtcccttcaccccccgcctgcccgagccgtcccgtcgccgtttgcaccatcactaccatcatggcaagctcgtcggtgcttgccgtccctcctcccttccccctccccgggcgcctataaaagggaccgcccgagctccgccttctccacaccagcctcggctacctccccctccccttccccgagctcgattgagccagcgccgccgcgccctcccttcgctccggtgagctccgtcctcccctctctagtagcgtttggtcaaattgctctagctcttaaggtccaccactctgtcacaagcctagtgcacacctactcgtcacctattgcgcccggtggcctcgccggcgacttcaccaccgcgagcgcctgccacccgtcgtggaccggccaccccaggcctccaccggtcaaattgaccccacctccgtgacccctacccccgcctgtgcctcgccaccacttccccgtcgcaaaaccggacccgcggcggagaaccaccgcgggatttcatcggcggccaaaccccggccggctccctctcccccgtcaccgttcaacaccgtcagcctcccccgtttctctggcacgtgggcccacatccacggcgtccgccgcgccgtcccccgctcctcgtgggccgtctgggcccaattggccgcgaccgcgcgcgcgcccgcgcccgaccaggccgaaatcccccccggcccggttaacctggaattccttttctttttttccttttcccatttctttttcccattttcacatatataattatatgctgatattttatgcaccaaaaatagtttaaataaattatagggcacaaaaataataaggtataataattggcacaccccactaagtcaccatgattgatgtattgttcttatttgtgcttgttagcggaagagggatccgatcctccggaatttgtagctccgaaagaagggcaggaacccgacccctccgagataaatcttttgtgccaggaaagcttcgacgaaggcaagtccatccttcccttgatgcataatttacctattctctctaccactacctaaaccgggattaagggatggaaataaattgcatggtgagcagagagatagcctgcattaactaacatcttttgatcacaagatatgggatgggaaaaaggggcagtggttttaaccaaactatgttttcaaaaagtgtgcgatgaagggtattcaccctcatcacctagtgagtgggatgatcagggactccctggtttaggggagggcctaaggtgatggctcaactggtttaggtgtgagcagaaggattgtcccctcatataaggaccggtttgtcatccttcactacctgtactcatgaaaagtacaaccactcgaggctgtgtgggcagtcactcgatctgaactcgtacggtccaaccccagggttatgaaggctggggagcaccaggaggataaggagggggaatgttttgtccggtttggacatggcggtggcctgactccttctggtataactgttaaggttaggacgtgcgaggaaggaaagagattcggattcgaatctcattagccatgagatcacagagccggactagtgggtaaagtgtacccctctgcgcagagttcaaacctattcgaatagtctgtgtccattggaatggatgagtctggtgtggtatggcaattagtgttttacaacatccatgaacagggaaatatgtgtgtgtgagtgtctctagaaaagaaaatggtgccacgggagcgggaagctcagtggtggttaagcaacgtgttacttctatttcttcgggaaaaccctaaacagtactgcctttctctaagaaaaagaagagtgacttcaactccaccatatgaagcatgtatgatatatgtctctttctctttacgggagcggggtgggcttgcggaatacctagtgtattcacctagatttattcatgtttttcagcagctgaagacttcttttctgctatgcttgattgagggggttgtgtcttcacccagtttctgcctgtggcttgggctagtttatcttctactgcgctttgtatttctggctctctcaagcttgtactctggtattgcaataacttttattcgaactctgtactatttgaagtaaggaatgtggttactagccttctgggactactaattgtatcacatttgagtcccaagggatcagggcgcttcaggtggtatcagagcccataggactggccgtagaccgcatccctgaccttaaaagttgccttaacaatcaaacacctcttacccctaagaaaaaccttctctcatttccccgatattaacagacccttcttttctcctaccagatggaaggctcttgggtcattaggacatcctactgctcagaggaggaaggatttcctcacctcttacggagttgcgcgctatgcatggggattcgcaagaagccggaatatgtctggaaggaataccgcgaaaatggagtggagaagtgctctatggcggtctacctgggagaaagctgaagttacccaaaccaccctcccttccatgtcaccttcatcgagcaccgcttcccagacacttgccaaagtgttgcccgaaaagcccttaaacagctatgccaaaactacagtagagaggtctttgaaacccccttcgttacttcccacctagcaacaaaatacccccacctggaggaaaagacttcaggccctgtcagggagagatcctacagaagatgaccccaccatcgtctacatggtcggatacctccacactctcgataaccactacgacgacctttcctcccactgcacccacctaaactcccaggtggaaagcttagagcagcaagtcaaggaacttaagaaggataaggcatccctccaagagtgtctcgatatagcagaaggcgaggaggccaacactcgtgaagcctaccgagacctgaagatggattacgataagaagttaaagaagctcgcccccacgaagaaaatccaaaagaagaccaacaaccaaggatgccaagctgagcggaggaagaaagcccctccagcaccacctcccgccaggatagagaatttgtccgacgtcgaggatatgtccctagttagccttgatggccttctcaaggaatttggggacactttagaaaaagagttcggaagtaccttagagaacgctcgcgtgtagtacgacttgtagtagttgtatgcttgtaatgaattggtgtaatgaataaaataacttggttgaaattttttttggcatatgcataatattgactctctccccctagcagatggcttcggataaaaccatgcctaccgcctccgggattggagcagggtttcccctaagagctgaaagagaagccgatagagaagagagtgagacctacctccccgcacctctagaactacccttagatttagcccaagttctagccaaccaaacccgactcattgaggtcctcactacaggaaacgactaaattttcgtgggctaaaaacccacgaaaataagcctaaaccgacgaaaatagcctattttcgtcggcaggccgacgaaaatagccgccgaaaataagttcgacgaaaatagggaattattttcgtcggtaccgacgaaaacgacttattttcgtcggcttctctaaggccgacgaaaatagttggtcggctgactattttcgtcggccactgaggccgacgaaaatagggacataattttcgtcggccgacgaaaataattccctattttcgtcgaacttattttcggcggctattttcgtcggcctgccgacgaaaataggctattttcgtcggtttaggcttattttcgtgggtttttagcccacgaaaattgagtcgtttcctgtagtgaggacctcaatgagtcgggtttggttggctagaacttgggctaaatctaagggtagttctagaggtgcggggaggtaggtctcactctcatctctatcggcttctctttcagctcttagnnnnnnnnnnnnnnnnnnnnnnnnnnnnnnnnnnnnnnnngacgtattttcaagacatggtatgacgattgtgtgcaccggatgattgaaaacgcaatggtttccccagtttcacattgcggtggcctgatttttctggtatatctgttcttttaggtattcgacgcattgaatagattcggattcacgttgtcatagccctccggtcccacagccctgttagtccttactttttatccctatattctaatcccttgcgattccactacttcgagttcatgcaggggataattccggtgttcatgggcaatgagcgtgttacaacacccatgaagacccacgtatgtgttttgtagtgtttttataaaagaaaacggttcaccgtgagcgggaagctcaatggtggctaagcaacgtggtatttctatttgggtcgggaaagccctaataagtattgcctttctctaataaaaagaagaatgacttcaactcccccatacgaagcatgtatgatatatgtgtttttctctttacgggagcgggctgggcttggggaatacttagtgtattcacctagatttacacatgtttttcagcaggggcacccaggccgacgaaaattcatgataccccccaaaaaacagattgttctgcaccttttattaattcacagcaaaataaacatatacacaatcatatatacagatttcacaaacaatacagttttcacaaacaacattcacaagcaattacataattgtttcaaacatattccatacatatagtccatatatagtccatacataaacaaagtcattccctcgagaaccataaacaaagtctatacatatccatacatagtccataaacaaagtcactactcactccggcgggctatgtgagttttggccactccctcctccgccaccaggaaggtggccactccctccagaaccatggacgaggaagtcttggacgttgacagcaccctccgatccctgagcatgtgacgctgaaccctgcaattcatcaatcattcaaataaggctgtgtttggtcaatatttgtataaaactaaacatggaacgtcacctgtgatccatggtgaggaggaggctgtgcatgcatccacgggtactgttgtgctggccacccctgaggtggtggcacccaccccgtcggtggcggtgccatccacgcttgaaatggttgagagcccgccggtggctgaaagaccggtggcacccatcccgggactggctgcgatccttggggtggtggaggtgtccaagtgcctggaggtgcctgcgtccacccaacaccagtccactgtggctgcgacgctggagcttgtcctggccactgtccccatccttgtgcctgcgagccatttttgataataaaaaaagagttgctatggaattgaagtgttcagatagtgttacctggggagggcgaaaagctggcaagttcatatcagggccgagtcgagtagtcatttcctgcaaatggatgaaacgttagaatcgcaacattatactttgaattcaatgacacgtgatgagatagatgaattacctgaaaataagaagtcatatactgcgtcagctgtccgacctgctcctgcgctgctcgagcctgctcctgtgctgctcgagcctgctcctgtgctgcccgagtctcctcctccagctgagcctctcgagcagatttggaggagcgagaactccctgccgaagatgatgttttcccttgacctaatgtcctgttgtactccacaacgccggtgccaaaggcaaacctgcatgatacacatagttgagccattaagtggacacattcttgttaatgaaattgtcgaatcaaagacaaccacctcacctgccatgctttctacccccaccactgtggtacaacgccgaagcatctaagtctgaatgcatccagtcgaaatcaggcccatggcgttgagtcatttcctccccatatgcattctgcaaagaaagttagagttggagttagacacaaaacatgcaatttaattcgtaaatacaacttgtttaccattttctcccttgccgcctcgctgcatagctcatcagggttcgccggatcagggccacggtgaccacggacgtaaacctccataaaacttggagcaactccactttcagcttcctgcatgaaaaagaagagttaaaccatataattttcatagatgtaacatacaagtttgatttatatacttaccatgcggcgtgcggtaccaaggtgtccatcggcgccgtacctatgccctggtccttcagtgccacggttgacacggtgcttgttcgactctgcaatccaatcaggcgacgcccatctctttgccaaccacctccaggcttccatgtccttcgccagccaatccacaacgctctccaggtactgctcctctgtgaacggtccagcttgtcatcctcctcaaagaatagcatgcaactgttgggacacacgtcgatcttctcatatgtcatcccaagaccagccaacatcttctttgcgaagtacatattttttggcaacttatgattctccggtagaacctcgcccataagttggacgatgtcgttgtaagcactgtttgaaatgttgtgcttcgactttatcgccattagtcttgtgagagtcccaagaactgacatctgagtgtgctcgtgcagtctctcttctcctgcggcgagtagtcggaagaattcttgagcatcgcgtggaagctgccccggctcctcagcgttcatttcaacctccctaccaagatcatgcaacatatcgtccatcctatcatgatcgtcatcaagctccacatccgcgtcaacgtgtctaatagactctccatgccggtaccatacaaggtagttcgacataaacccacttttgcaaaggtgtttctccatttcttccttcttctgaggccacttgttctcgcagcgattgcaaggacacttcactagacgaccagttgcatctttgaaagcgtgctcaagaaaagcctttgttacacccatccattcattcgaatgtgccccatcctttctccacccgtcatacatcaccctccgatcaccgtccatttcaaaggctaaacaaaagtcaaagaacatcaacgatcgtccgtggcttatttaggtgaactccctattgggtaaaggccctaaacccacccaagagtgtaggctgatgcttgtgatttatgacgtgtagcctacgattgccgcgaaatttcggcagcataaccccgctgctctccaagcacacgcctgaacatggtgtgttggagaacaactgggttacaaaaccgaaattctgcatcaatcgtaagccacatgtcacaaatcacaagcatcggcttacactctcaggctgtccaaaatacgtggacaattccggaacggcgaacctcacaagtcaatgtgacgttcgtcgttcccgaacgggtgacgcatacggttcgctacggttaacgattaaaactgagaataatgtatacatgagaaattacgaaaacaatgtatacctgagaataatgtacgagtctagctaacgatggcgaaggtcaagtcggaagaacacctatatacaaaaaatattattgtcaataaaaaattcggcagcacctcccctataaagtgatgtttctaaaacctgcaaataaacgacaacacgatggttgccaacacagaaaactacacgatagctacataataaacaatatgctgaccagtatatgctaaacaatatgttgaccagtatatgctaaacaatatgctacaagtatatgctaaacaatatgctacaagtatatgctaactatatactcagtaactttccttcatccaatatactaacaatttcctaactatataatcactatatagttagtttaacataatgctatgttaaacaatatactttaccatgtgctaagtaactaaaaaaatttaaaattttacctgtcggactaggaggcgaggcggagctcggtgcggctgcggcgagggacggcggtggagagagccggtgcccgaggctctcgggccgagggcggtggtgggggcgaggctgccgagcagtgggggcgcgtgtcaccggagctgcacgggcaaggcgggcgcgaggcgggcgcgcagcgggcgcgatggggcagaggcggtgatcgccggtgggcagaggcgggcgcgcggcgggcgcgcaaaggcaggcgcgcagcggcggctcgcagcggagggcgcgcagcggcggcgcggcaggcgtgggcgcgcggcgctgcagcggcgagggaggacgggcgggcgggcggcgttgcagcggcgagggaggacccgacggcggcgagggaggacgggcgcgcggcgctgcagcggcgagggaggacccgacggcggcgcggagacggagagcgggcgggcggcggcgcaaagaagaagtgcgagacnnnnnnnnnnnnnnnnnnnnnnnnnnnnnnnnnnnnnnnncgctccaacaaatactctacttatcctcgtctcactctgccatttaatgttacactaaaaacttgaggctgataggtatcctttcgtacacaggttacgggaatgtcattacggtttattctttagaacctacttctgttcgttttaactaaaggtcctgtgtcgtggtttatcataacggctatgtcgtatgggataactagttaatctcatcttcattatcgccacactccatttggttcacctcgtcgctttcctcttgccagatgacctcatcaagtctaatgttcatttctgctccacctctttctcattgcgtggtcatccaatttaacatcggtcactggcttcaaatcaaggcatagtgatatgttgttccgttacccacgtgctatgccgtccccagggaaagaatgaaatctttgctgtcctgtaatgacaacaacgagattaggtgtgacccaacagcctgataccaataaccaaccgggatgcatcagtaaaagaaaataacatccgttgattgtagtgcaatagaactgatgtcgcagttgaacacactaagtttaggtcacaaaaagatgttggtttttttgaacggcccccgggcccaggaaaatatatttcctattttcgtgggccggccgacgaaaatatgtactggcccacgaaaataagccaaattttcgtgggtcccgagggccgacgaaaataactatgtaatttcgtgggccgaccgacgaaaatagttaggcccacgaaaatttatgcgtttcctgtagtgcctcactagaagtctagaaaatcaacgcccgaatggtggaagaccacaagataggatgggagatttcctgaggctcaagcctcccacattcgctggatctagcaatcccctcgatgctgatgattggctgcgcacgattaaaaggaagctagagccatcggatgcccggagaatcagcgtgttcaactgggtgctcatcaactttccggaatggccttagcctggtgggataccttcaacgctgccatcagagatgctacctgggcaaagtttgaaactgctttccgagagcaccatgtgccccaagggatcgtccagctcaaggaagatgaattccgggaactaactcaagacggaagatctgttagtgagtacgtgcacaaattcacagagttggcccgctacgcgccggatgacgtcagcaccgaagtcaagaagattgcacgctttttgaaggggctcagaccagaactcaagaccatcctaactagccaagacttcctcagcttctcgcacctctccaacaaagccatgcaagtggaaagggcaagggaagaagaaaaaggccacctcaagaggaaattccaagtcctctgagctcagcagcaagatcggcaccagagaactcgatcctttgggtttccacctaagggaccaagcttcattagaccaggtggacccactccatcacggttcagtcagcagagtcagagctcctttcatgccccctcggttgcaagcaaccaaccacgagcgaatgcgtgttggcactgcggagaccccagtcacttcaagaacaactgcccccagttgaaggcatcaggacctgcttactccaactcggtgaatggccccaagaatacctcagcacccacccccaaggcgccctcctccatcagccagcagaacaagacccagtatcaaggaagggcttgagtaaatcacgtcgatgctcaggaggctcagcaagctccgggagtagtgctcggtgagttccttgttgaatttactccctctactgtacttttcgattcaggagcatcccatttttttatagccactagttttgtggaaaagcatggcatccctctatccctctagagattcccttggtcacccgaaccccagggtcaaaccttctatgccagctcaaatgctcccaagtcaaaattcttttaagtggggtagtgttcttggcagacttaaccgtcttgccatcccaaggaattgatgtgatcttaggaatggattggttgaccaagcacaaaggtatcataagttgcgcaaacaagacagtccttctcacagaccaccaaggaaagtcagtctcttgtcaggctcagccacccgccaatgacccaatgatgtttaatttagcaacaaaaagcatatcagtggtagaagaattcatggatgtattcccagaagagttgccaggaatgctgcccgaaagagaagtagaattctacatagatctgattcctggtacggcgcccatcgcaaagagaccataccgcatggctcctaccgagttagcagaattaaaactccaaatcccagaccttcaacaaaaagggtacatccgtcccagctcatccccttggggagcaccagtcctcttcgtctctaagaaggatggaagtatgaggatgtgtattgattaccgatctttaaatgaagtcacaatcaaaaacaagtatccactccctcggatcgacgacctcttcgatcagcttcaaggggccaaatacttctccaagatagacctaaggtctggttatcatcagctgagaatcaaggaagcagatattcagaagactgcatttgtcacccggtacggacagtatgaattcactgtaatgcctttcggacagacaaacgcacccgcctttttcatgaacctcatgaataaggtatttatgaaagagctggataactttgtcgtagtcttcattgacgacatccttatctactccaagaaccgcgaagaccataagcgtcacctccggaccgtcctcgaaagactcagggcacaccaactttatgctaagctcagtaaatttgaattctggttagaaaaagatagcctttccttgggcatatcttgactgcggaaggaatagaagtagacccttccaaggtagaagcagtgtcaaaatggaggcagccatccaacgttagtgaagtttgaagctttctgggaatgacaggatattacccccgctttatcaagggattctccagcatagcaagacctatgtctgagctcctcaataaagacaataagtttgtgtggatcccataatgtgaagaaagtttccagatcataaaggagaagctcacgaccacacctgttttgacactaccggatatacaccaggatttcttcatcttctgtgatgcctcaaggcaaagcttagggtgtgtgctgatgcaaaacgagaaagtcattgcttatgcatcgcgcctactcaagccgcatgagcagaattatcccacacatgatttggaattggcagccatagtgcatgccctgaaaatatggagcactacctaattggaaacaaatgtcacatcttcaccgatcacaagagtctgaagtatatcttcactcagccagatctcaacctccgtcagagaagatggctggaaccgatcaaagattatgaccttgagattcattatcaccccggaaaggccaacgtggtagcagacgccctcagccgaaaacctttcgggataaagggaaccaacttcttagaagattggaagaaggaatcagctcaactgaatgcatgtttgggaaacaacggcagcctagaagtcaaaccaatgctagaagacctgatatgcaaagctcaacgcctggactcagagatagcaagacttatggaaaaagctcgcaaagaacaacttccggacctcacgacagatgaacaaggagtcctttggttcaagaatcgtctatgtgtaccataaggggaggcacgagaagtcctactcaatgaagctcacaactcagcctactccatccacccaggaactaccaaaatgtacctagacctcaaaaccagatactggcggagagggatgaagaaagagatagcacagtatgtggcccggtgtgacacctgccaacgaacgaaagccgagcaccagaagcctgcaggcctattgcaacccctcccagtgcctgaatggaagtgggaggaaataggcatggattttgtaaccggactaccccgacgcaaaaagggaatgactctatctgggtaataatagaccgtcttaccaaggtagcccatttcatcccagtgaaaaccacctttggaggagccacccttgcccgaatttatcttaaagagatagtcagactccatggcatcccaaggaagatagtgtcagacagaggaacccagttcacctccaaattttggacgagccttcagaaagctatgggcaccaagctagacttcagcaccgcctatcaccctcagacagatggtcagacagaaagggtcaacaaggtcctcgaagatttattaagagcctgtgtgttaacattcgatagaagctgggaatccagtttgccttatgcggaattctcgtataacaacagccatcaggctagtatcatgaagcgcctcgatcctctgggactcaaatgtgatacaattactagtcctaggaggctagcaaacacatttatacatcaaatgattatagatctgcttaaacgagacaaacctataaaggtagtgatcaactttaagagttggtccacaactcgggacatatcatcagagtggggctgaagcagcccgatatacgcagcgaagcaaatcagcggtccaacagccacaggcaaggttgggaacagtcgtaactcttacccgatctcctttttctgaaaaacaacaaataagcaagggtgagtacaaacatactcagcagcccaccttcacccgcggaatggggaaatcagatataatacatggaatatgtggagctcaggatattttgcagaaacaacaatattttatgcagggttgttttgtaaacattttgtatttttcaaagcgcatcctctcccaaaggagcgggaagtttttcaatattagaacaaaatcccctggactaaaccatccaggcatctcagcagtttcccactagtttttccttttttcaaaaacagctactggacttctcgtccaccatagctcacggctcaaccgccgaaccttttaaaaaccacttttctcaaacgcaccttttttttaaataaaacactaattgtcataccacaccagactcgtccattcctgtggacacagactattcgaataggtttgaactctgcgcagaggggtacactttacccactagttcggctctgcgatctcatggccaatgagatccgaatccgaatatctttccttcctcgcacatcctaaccttaacggctataccggaaggagtcaggccaccgccatgtccaaaccggacaaaacattccccctccttatcctcccggtgctccccagccttcataaccctggggttggaccgtacgagttcagattgagtgactgtccacacagtctcgagtgattgtacttatcatgagtacaggtagtgaaagatgacaaaccggtccttatatgaggggacaatccttctgctcacgcctaaaccagctgagccatcaccttaggccctcccctaaactagggagtccctgatcatccctactcaaaggtgataagggtgaaaacccttcatcatactcattttgaaaagcattttcttttgaaaattcacaccttttctcaaatcatttgtaacaaatatatcaaggattgattgcggcaagtggctgggtggccatgataacttgtctcaaaatcatatcatgcataaaataacaggctgagggttgtggttaaaaaatcataggtaatttatgcatcaaagggatccagtgagcttgacgtgcttatccagcgaagggggaaggagagcttgcggaactggcttctggctccaccgcctggcgtagacttgcagatctggcctccacgagacgacacgaacgctccgataactatgcaacatgaacaagcaaacatacaaaccagcaagtataccaacaaatatttagtatagtggtcagaaaagcgatatatggatgggtagagtcttgagtagaatttgtgtcattgtgatattactggtggtggagcagaggtgcttaccaggagggtggactggaggcgaagcgacactatgcgtgtagccggcagagcggagtaactgagtgggtggagtgtttgccttggctgagggtgttgagtgtgtgtggagagggagagggtagctgggtgtatttatagctgagtgtatgtggtgtagcatagtgaagttcactgttggtgagaatagtgacgaatgaatcgtctgacttagtatgaacatgagagttataggcaaaatatgggacaagagtattttaggagttatatggaatatgaaccatgcttaagggatgacatggttggatagggaatagtttgataataacttagaaatgagaattattggaatctaagtttggaagcctagttcgaaggaatctcaaagttaagcgtgctcaacttggagaaacctgggattggtgaccagatgggaagttcctactggaaggaaaatcacagtcaccggagttcgtgtgactggaatatgggtctgactggtcataggtggactggacaacatgatggatgagtagttgaaatttgggggggggggtgatcgtatgaacgacgaataataacaataatgaatagtaacagtgaatagtaacgatgaatagtgatagtgaatacgtgtgagcatgagaaaagttatgaagaaaatatttatagggacttgaaaaatgattctgaaggtatttctcaagaggaaaatacttggagatatatcagtggaatatttggacagtatttctggaaagaacttgaaggggattactcgggaaatatctgggcggtatttctggaagaatttgagggggatcactggggaaacatttgtaggatattttgaggaggattttagagagaatatagaccactatattatatttgttgatatcaactcgcaaacaaatattttgaaatgaaatttgaaattcattttgaatttagagcgagtttgagaaaatttcaagatttgaatttttgggatgctacaaatctaccccacttaaaatgaatctcgtcctcgagattcggcttagaagggttatgggtatagctttacctcagctacatatcttcactttgcgactcttcgaggagatggagcttcaacaaaatctggcctttgaggagcatctggttgctgattgcaaacgttgattctggctactcaaagatcatcttcaggcttctggcttttgcttggcagctagcttattgaggaagcatcgatgccaacacacaaacctttctcttgcgaactcccacatggattccttccttgattggccttctggtgcttcatcaacggaacttggtgaccacttctcatctagaaacttataagctttgatgatccggtcctccacaagcttgctacaagccttcttctttttttccatagcaggaaccttgctggaacactaccccacttaaaaagaataagggtagatctcttgaatcttggggatttgaactccttgaagtacctcataacaagggtgttacagggccttcttctgctattgttgcttgagcaggctgtggagaaataattggcacagggttgattctgggagaaccttcttcttatcttctcttcactatcttcttttcactgacccttcctttctctttgctcttcccactggaggattctatcaaagagtattactatcatacactataggaaaccaaagactatgaaccatgtgcaacagtcttcaacccaagaatcaccaagcattgtgatctcaggggcgagagagtggaaaatggagttgcttgcaatttggcagagggtattttatcaggtgtgtgctttgctttgagcgatatgggagttgagggagctggggggaatttataggcgagtgggggtgttcggttgcggagtggcggtgatggagaggtgacacaaggcagcaagtgcgacaagaggaaggggggcctgttgctggcgacgatggcggtgggtgcactgcaaaagggggcttgggtggcggtagtgcgcttcaaagggaagtggggcggtggtagtgcgcatggaggcgggcacacgtgcgaggggcacgggtgagtggtggggtcaatgaccctgatgtttgtggtctctggttccaagaatctttgcctctgtgtatggtaataactccttttgttatctttttctgtttactttgactcaggggcagtgctttgattctcacggtcggtccttttgactgagcggctggactgatttcttttgtagcttattccaggctttaagggtaagcttcccggtatcttcttgggtaaggcacttttctcttgagatgggttaagatgagaatggaagcataaggtgaggattagctctaatttgtgatctatgtttttagagaaaacctttcttaaaaagaaagaaaacacacaagctcaacaatcataagcacaaacaaatcaaatgttttaaatagggaaagaatagagttttttcaaagcacggactactcagattcgggggctaagcataactagtattgctcggctcctgaactgagaactatgataaatgcgacttatgagcactaacgttaaagcatcacatatgcactcaaaaggggagaaaacgtcaagcagaattcattttgaaatgccctagggggccacacaattagagttttgcaaaacacgagtctacacgattacctctcatacatgtagggctctggccaaagtgaagaaaaaacttcactacccaatgcatgcagaggactgggcataactaacttcagatctgacagcttctcttctggcgaggctggcacacacttcaatttgagatatctcctggatgggttaagagggagctgatgttgatgacttcttctggcggcgactgagatggcaacacggggttgaactcttcttcaagcgggactggctcctgcagctcctcagagggcggcggtgttggtggggtgcttgcagcttcttccttgacttcaagggatggtgctggaaacttcttcatggtgagaggctcaaacaactctggcgggggatcttgggaggactcggggtgctcttgcttatccatagcctgaggggagactggaattccttccaagaccatggctccttccgggagttcccaaaccttcttctctcctctgatagagactgggcgaccttcaagaatctgggggtcttcagctctcatgggttgaactgggttggatgaagcgggctcttggatccgcagggctctacgttggttatgggttaccaagtaggcctccatcaacttctggacatgctcatccttggcttgcttcagggcttcaacatcaatgacttcacgactttccaaggcagctacatgggcttgagctgtggtgagatccacatggagctaacggttgtgcttctctgcatcttctgctcgggcaatcatctgacggtggtgtcgagccaagaaatcatactgggcatccagggtgagcaggtatgcggtgaggtacacgactgaggggtcgtcctcaagcagcagctgctcttccaatgcatgcatcctggccatccaaacaggacagtttctatgaaagggcggaaagaatctgagcggtgtgtcggccacttcttcttcatagatctgacacagggccctcaatgccttgcgaacgacgacttggcatgtgtctttgaatctgtgcccagcagcagtgacactccattccacatggtgcggactggatccaatatatacagtcatgacacacttctttgtgccatgctcgacgaattcatgaccatcatactctggctggctcctgattccgaggcggactgtgcatgctctcagcaacttggggaaaccatcttcattctggcaaaagctggtttggcaacgaacctccatctgacttctgagagaaggaaagggggaaagcatttttgaaatgaagggatgagagcaagatttttttaagaaaatagttttgactcaaaaacttttggatcaggctaagggttatgtcctgcagccaacataacagttctgataccacctgaagcgccccgatcctctgggactcaaatgtgatacaattactagtcctaggagactagtaaacacatttatacatcagatgattacaaatctgcttaaacgagacaaacctataaaggtagcgatcaactttaagagttggtccacaactcgggacatatcatcagagtggggctgaagcagcccgatatacgcagcagcaaatcagcggtccaacagccacaggcaaggttgggaacagtcgtaactcttacccgatctcctttttctgaaaaacaacaaataagcaagggtgaatacaaacgtactcagcagcccaccttcacccgcggaatgggaaatcagatataatgcatggaatatgtggagctcaggatattttgcagaaacagcaatattttatgcagggttgttttgtaaacattttgtatttttcaaagcgcatcctctcccaaaggagcaggaagtttttcaatattagaacaaaatcccctggactaaaccatccaggtatctcagcagtttcccactggtttttccttttttcaaaaatagctactggacttcccgtccaccatagctcacggctcaaccgccgaaccttttaaaaaccacttttctcaaacgcaccctttttttaaaataaaacactaattgccataccacaccagactcgtccattcctgtggacacagactattcgaataggtttgaactctgcgcagaggggtacactttgcccactagtccggctctgcgatctcatggccaatgagatccgaatccgaatctttttccttcctcgcacatcctaaccttaacggttataccggaaggagtcaggccaccgccatgtccaaaccggacaaaacattccccctccttatcctcccggtgctccccagccttcataaccctggggttggaccgtacgagttcagattgagtgactgcccacacagtctcgagtggttgtacttatcatgagtacatgtagtgaaagatgacaaaccggtccttatatgaggggacaatccttctgctcacgcctaaaccagctgagccatcaccttaggccctcccctaaaccagggagtccctgatcatccctactcaaaggtgataagggtgaaaacccttcatcatactcattttgaaaagcattttcttttgaaaactcacaccttttctcaaatcatttgtaacaaatatatcaaggattgattgcggcaagcggctgggtggccataatagcttgtctcaaaatcatatcatgcataaaataataggctgagggttgtggttgaaaaatcataggtaatttatgcatcaaagggatccattgagcttgccgtgcttatccggtgaagggggaaggagagctcgcagaactggcttctggctctaccgcctggcgtagacttgcagatctggcctccacgagacgacatgaacgctccgataactatgcaacatgaacaagcaaacatacaaactagcaagtataccaacaaatatttagtatagtggtcagaaaagcgatatatggatgggtagagtcttgagtagaatctgtgtcatgtggtgttgtgatattactggtggtggagtggaggtgcttaccaggagggtggactggaggcgaagcgacactatgcgtgtagccgacagagtggagtaactgagtgggtggggtgtttgccttggctgagggtgttgagtgtgtgtggagagggagagggtagctgggtgtatttatagctgagtgtatgtggtgtagcacagtgaagttcactgttggtgagaatagtgacaaatgaatcgtctgacttagtatgaacatgagagttataggcagaatatgggacaagagtattttaggagttctctggaatatgaaccatgcttaagggatgacatggttggatagggaatagtttgataagaatttagaaacgagaattattggaatctaagtttggaagcctagttcgaaggaatctcaaagtaaagcgtgctcaacttggagaaacctgggattggtgaccagatgggaagttccctactggaaggaaaatcacagtcaccggagttcgtatgactggaatatgggtctgactggtcttaggtggactggacatcatgatggatgagtagttgaaatttgggggtgatcggatgaacgacgaatagtaacgatgatgaatagtaacggtgaatagtaacgatgaataattatggtgaatagtaatggtaaatagtgatgagaatagttcgtatgaacgaacgatgaatagtgacgatgaacgaacgatgaataggaactatgaacgaacgaacgaacgatcgaatgaccggatggacgagcgatcggaatttcgacagcataacggcaggacaaagattatctggaagaacgatgaatagggactataaacgaacgatgaacgatgaatagaaactatgaacgaacgatggacgatcgaatgatcgaacgaacgaacgaacgaacgatcggaatttcggcagcataacggcaggaaaaagattatttggacgaacgatcgaacgatcggacgaacgatccatgaacgatcgaacgaacgaacgaacaaactaagaacagggggatgaacgatcgaagaacgaccgaacgatccttgtgctagtgtgtgcttgtgtggaacatggagtgggtgtgtgtgtggggggggagagagttgtcatgaaatggcttggggtgggatgagaggaggcccttgcccctctatttatagccatggtggggggattagggggagggatgagaggattagtgggaggatgagaggattagtgggagattagcatggatttgtcttatatgagtgtaattagcttgtagagctcaacgtatgacaccggaggcatacatatacgtgtgagcatgagaaaagttatgaagaaaatatttatagggacttgaaaaatgattctgaaggtattcctcaagaggaaaatacttggagatatatcggtggaatatttggacagtatttctggaaagaacttgaaggggattactcgggaaatatctgggcggtatttctggaagaatttgagggggatcactggggaaacatttgtaggatattttgaggatgattttggagagaatatagaccactatattatatttgttgatatcaactcgcaaacaaacattttgaaatgaaatttgaaattcattttgaatttagggcgagtttgagaaaatttcaagatttgaatttttgggatgctacatatcaagatgtcaccgtttgaagcattgtatggacgaaaatgccagacccctctcatgtggtccaacgtaggggaaaaggcactggaagggcctgcctttgttaaggaggctgaggagaaagttgccctgatccgcagaagattacttgaagctcaaagtcggcagaacagttatgcagacaaaaggcggagataattcagatttgaggaaggagacttcgtctacctcaaggtctccccgatgcgtggtgtcagaaggttccaagtgaaaggaaagctagcaccgtgattcgtcggcccctatcccatcattggcagagtgggacccgtagcgtaccgtcttgaattaccagaatccatgtctgatatccacaatgtgtttcaagtgtcccagctccgcaaatgcctgcaagtacaagaaagtcacatcgaagaagaggcaatacagattcagaaagatcttcagtaccgtgagaagctaataaagattcttgactcagcagtccgaaagatcagcaactcagaagtgagactctgtaaagttcagtggagcagagaaggagaaggggaagctacctgggagagtgaggactctttgaggagggaatacccttaccttttctcaaatccagtctaatctcgagggcgagattcctttaagtggggtaggtttgtaacatcacaaaatttcaacccaagttttggaaccctaatctcctaacccccccttatttttatctctccctaaactccaccatatgcatacactttgattgttagaagcacctcacatagattattttaacacctaagattatttagcaaattgttgttcaaaagaaaaggagataaaaagaaatagaaatagaaaataagaatgagaaatagaaaatagaaatagaaaaaggaaaaactctcccccctcggctaggccattttccggcccaagccacttccccccctctccctcccgcggcccaagcagcccagcttcgcgcgcccgcgcctgacagccgggccccacccatcagctactcctcccctctccctctcgtgtcgctctcccgctggcaacctgggcccgctcgtcagacctctcgtctcgcccatgtcttcaccgacgcgttcgccgccgaccaccgcccgccccgtctcctcgccattaacgcgctcaccagctcggttggcgccatgcacccccgctcactgtgcccgagccgtcccttcacccccctcctgcccgagccgccccgtcaccgtttgcgccatcaccaccatcatggcaagctcatcggcgcttgccgtccctcctcccttccccctccccgggcgcctataaaagggaccgcccgagctccgccttctccacaccagcctcggctacctccccctctccttccccgagcttgattgagccagcaccgccgtgccctcccttcgctccggtgagctccgtcctcccctctctagtagcgtttggtcaaattgctctagctcttaaggtttgccactctgtcacaagcctagcgcacacctactcgtcacctattgcgtccggtggcctcgccggcgacttcaccgccgcgagcgcccgccacccgccgtggaccggccaccccaggcctccaccggtcaaattgaccccacctccgtgaccccctacccctgcctgtgcctcgccaccacttccccatcgcaaaaccggacccacggcggagaaccgccgcgggatttcaccggccgaaccccggccgactccctctcccccgtcaccgttcaacgccgtcagcctcccccgtttctctggcgcgtgggcccgcacccacggcgtccgccgcgccgtcccccgctcctcgtgggccgtctgggcccaattggccgctgccgcgaccaggccgaaatcccccccggcccggttaacctggaattccttttcttttttccttttcccatttcgttttcccattttcacatatataattatatgctgatattttatgcaccaaaaatagtttaaataaattatagggcacaaaaataataaggtataataattggcacaccccactaagtcaccatgattgatgtattgttcttatttgtgcttgttagcgtaagagggatccgatcctccgaaatttgtagctccggaagaagggcaggagcccgacccctccgagataaatcttttgtgccaggaaagcttcgatgaaggcaagtccatccttcccttgatgcataatttacctattctctctaccactacctaaaccgggattaagggatggaaataaattgcatggtgagcagagagatagcccgcattaactaacatcttttgatcacaagatatgggatgggaaaaaggggcagtggttttaaccaaacgatgttttcaaaaagtgtgcgatgaagggtattcaccctcatcacctggtgagtgggatgatcagggactccctggtttaggggagggcctaaggtgatggctcaactggtttaggtgtgagcagaaggattgtcccctcatataaggaccggtttgtcatccttcactacttgtactcatgaaaggtacaaccactcgaggttgtgtgggcagtcactcgatctgaactcgtacggtccaaccccagagttatgaaggctggggagcaccaggaggataaggagggggaatgttttatctgctttgtacatggcggtggcctgactccttccggtataaccgttaaggttaggacgtgcgaggaaggaaagatattcggatttggatctcattggccatgagatcgcagagtcagactagtgggtaaagtgtacccctctgcgcagagttcaaacctattcgaatagtccatgtccactggaatggacgagtctggtgtggtatgacaattggtgttttacaacatccgtgaatagggaaatatgtgtgtgtgagtgtgtctctggaaaagaaaatggtgctacgggagcgggaagctcagtggtggttaagcaacgggttacttctatttcttcgggaaaaccctaaacagtactgcctttctctaagaaaaagaagagtgacttcaactccaccatatgaagcatgtatgatataggtctctttctctttacgggggcggggtgggcttgcggaatacctagtgtattcacccagatttatttatgttttttagcagctgaagacttcttttctgctatgcttgattgagggggccgtgtcttcacccagttctgcgtgtggcttgggctagtttatcttctactgtgctttgtatttctggctctctcaagcttgtactctggtattgtaataacttttattcgaactctgtactatttgaagtaaggaatgtggttactagcctcctgggactagtaattgtatcacatttgagtcccaagggatcggggcgcttcaagggcgccagaagattgctcgtgcgtcgctcgcgttagttactcctatagtgtattccttccattctgttcctgggcccacatgtcggggctcagcatccttgtatgtgccccccttgagctataaaagggagggcacacgacgttacaaggcacacccactcagacccaactcggacccaactcagacccaacttagactctcagactcacaagttcatacaagctctcaagctcaatactacacacagtggagtagggtattactgaaagggaaataggcttacaccttttcctaaatgattttggtggttgaattgcccaacacaaataattgaactaactagtttgctctagattataatatttacaggtgccaaaggttcaacacaaaccaataaaaagtccaagaaagggttcaaataagaagagcaaaaagacaaccgaaggctgccctggtctggcgcatcggactgttcggtgtgccaccggacagtgtccggtgcaccagggagatcaactccgaacttgccaccttcgggaattctgggagccacttcgctataactcatcggactgtccggtgtagcaccgaactgtccggtgtgccagtagagtaacggctaaacaacgccaacggtcgtctgcaaaggaacagtaaaacactacagtgcgcgcctgcgcgcgcagagtcagagcaggcgccagaaggcacaccggacagtgaacaatgactgtctggtgcaccaccggactgtccggtggcccagttgtcagaagctccaacagtcggaacccaacggcctggtgacgtggctggcgcaccagactgtccggtgcgccatacgacagaagccttcaccaacggtcattttggtggttggggctataaataccccccaaccaccacacttcaatgcatccaagttttcagccatcaaacctcatacaagagctctagacttcattccaagacagaaacaaagagatcaaatcctctcccaagttcggaatcactccaaacaaattagtgactagagagagagacttttgtgttcttttgagctcttgcgcttggattgcttttcttcttcctctattcttgttttaaactcacttgtaatcaaaacaagagacaccaagttgtggtggtccttgtagtggactaagtgtcccatttgattgaagagaaaggctcactcggtctaagtgaccgtttgagagagggaaagggttgaaagagacccggtctttgtgaccacctcaacggggagtaggtttgcaagaaccgaacctcggtaaaacaaatcaccgtgttcatccgctttatttctttgttgatttgttttccctctctttcggactcgattatatttctaacgctaaccccggcttgtagttgtgcttaaagtttataaattttagatttgcctattcacccccctctaggcgactttcaattggtatcggagcccggtacttcattagagcctaaccactcaaagttatgtcgggagctcacgctaagaaggagatggtgaccggcgagaagccctccacaagccacgagaaggctccatcgagagagtccgacaataagagtgaggaatcacctccccgcgccaagtcgcaccggagtggcaacaagaagaagaaaatgaagaaggtggtctactacgagaccgactcttcgtcgccttccacctccggctccgacgcgccgtccgtcacttctaagcaccatgagggcaagaagtttagtaagatccccttacgctaccctcacatttccaaacatactccattgctttccgttccattaggcaaaccaccggcttttaatggtgaagattattctaggtggagtgaaatgatgaaatatcacctaacctcactccacacaagcatatgggacattgttgaatttggagcacaggtgtcgtccgtgggggatgaagattatgatgcggacgaagtcgcccaaatccaacactttaattcccaagcaaccactatactcatcacctctctaagtcgagaggagtataataaggtgcaagggttgaaaagtgcaaaagagatttgggacgtactaaagaccgcacacgaaggagacgaggtgaccaagatcaccaagatggaaacgatcgatggggagctcggtcgatttatgctcaaccaaggggaggagccacaagccatgtacaaccagctcaaaaccttggtgaaccatgtgcgcaacctcgggagcactgaaagtcgcctagaggggggttgaatagtcaaatctgaaatttacaaactttaagcacaactacaagccggggttagcgttagaaatataaatgagtccgaaagagaggtcaaaaacaaatcacaagcgaataagagcggatgacacagtgatttgttttaccgaggttcggttcttgcaaacctactccccgttgaggtggtcacaaagaccgagtctctttcaaccctttccctctatcaaacggtcacttagaccgagtgagcttctcttctcaatcaaacgggacactaagtccactacaaggaccaccacaacttggtgtctcttactttgattacaagtaagttggaaacaagaatagaggaagaagtaaagcgatccaagcgcaagagctcaaaagaacacaaaagtctctctctctagtcactaatttgtttggagtgattccggacttgggagagggtttgatctctttgtttgtgtcttggaatgaagtctagagctcttgtatgaggtttaatgactgaaaaacttggatgcattgcagtgtggtggttggggggtatttatagccccaaccaccaaaagaaccgttggtgagggctactgtcgtatggcacatcagacagtccagtgcaccaccggacgctgtccggtgcgccagccacgtcaccagaccgttgggttccgaccgttggagcttctgacaacggggccaccggacagtccggtggtgcaccggacatgtcctgttcactgtccgatgcgccttctggcgcctgctctgacttctgcgcacgcaggcgcgcactgtagcgtttcactgttcctttgcagacgaccgttggtgttgtttagccgttactccgctggcacaccggacagtccagtgctacaccggacagtttggtgaattatagcagagtgactcccagaattcccgaaggtggcaagttcgaagttgatctccctggtgcaccggatactgtccggtagcacaccggacagtccggtgtgctagaccagagcaaccttcagttgtctttttgctctttttatttgaaccctttcttggactttttattggtttgtgttgaacctttggcacatgtaaaacttataatctagagcaaactagttagtccaattatttgtgttgggcaattcaaccaccaaaatcatttaggaaaaggtgtaagcctatttccctttcaatccccccctttttggtgattgatgccaacataaaccaaagcaaatatatgagtgcagaattgaactagtttgcataatgtaagtgcaaaggtttcttgaaattaaaccaatatacatttcataagatttgcatggatgctttcttcatatttaacattttggaccacacttgcaccacttgttttgtttttgcaaactcttttggaaattcttttcaaagtctttttgcaaaaagtcaaaggtatatgaataatattttgagaagcattttcaagatttgaaattttctccccctgtttcaaatgcttttcctttgactaaacaaaactcccccttaataaaattttcctctttgtgtttaagagggttttagatattaattttgaaaggggttataccaatttgaaaattctatcaaaaataagatatcaatagaaaaaccttcatttaatacaaatttgaaagactacatttttgaaattagtggtggtgcggtccttttgctttgggctaatactttctccccatttggcatgaatcgccaaaaacggatactttgtgagtgaaatataagccctttaactactatctaccctttggtaaataatataggagtgaagattataccaaattggagagtggtgtggagcaacggcgaaggatgaacaattcgatggagtggagtggaagccttgtcttcgccgaatactccatttccctttcaatctatgacttagaatataatacacttgaaaacacattagtcataacacatgaaagagatatgatcaaaggtatataaatgagctatgtgtgcaatatatcaatcaaaattcctagaatcaagaatatttagctcatgcctaagtttggtaaaagttttctcatctaatggcttggtaaagatatcggctaattgttctttggtgttaatataagcaatctcgatatccccccgttgttggtgatcccttaaaaagtgataccgaatggctatgtgcttagtgcggctgtgctcaacgggattatccgccatgcggattgcactctcattatcacatagaagaggaactttggttaatttgtaaccatagtccctaagggtttgcctcatccaaagcaattgcgcgcaacaatggcctgcggcaatatactcggcttcgacggtagaaaaagctacataattttgtttcttataagcccaagacaccagagatcttcccaagaactggcaagtccctaatgtgatctttctatcaattttacaccctgcccaatcagcatatgaatatccaattaaatcaaaagtggatcccctggggtaccaaaggccaaacttaggagtataagctaaatatctcaagattcgttttacggtcctaaggtgaacttccttaggatcggcttggaatcttgcaaacatgcatacggaaagcattatatccggtcgagaggcacataaatagagtaaagatcctatcatcgaccaatataccttttgatctacggatttacctcccgtgtcaaggtcgagatgcccattggttcccatgggtgtcttgatgggcttggcatccttcatcccaaacttggtgagtatgtcttgaatgtactttgtttggctaattaaggtgccctcttggagttgcttcacttgaaatcctaagaaatacttcaaccccccatcatagacatctcgaatttttgaatcatgatcctactaaactcttcacaagtagatttgttagtagacccaaatatgatatcatcaacataaatttggcatacaaacaaattatttgcaatagttttggtaaagagagtaggatcgacttttccgactttgaagccattagcgataagaaaatctcttaggcattcataccatgctcttggggcttgcttgagcccataaagcaccttagagagtttatacacatggttaggatactcactatcttcaaagcagggaggttgctcaacatagacctcctccttgattggtccattgaggaaggcacttttcacgtccatttgataaagcttaaagccatggtaagtagcataggcaagtaatatacgaattgactcaagcctagctacgggtgcataggtttcaccgaaatccaaaccttcgacttgtgaatatcccttggccacaagtcgggtgttgggggccttcggcttccgaaggtcctcaaaaacatgatttaacaatgtttctggagtataatgtgtgaacaggtatcttcggacttgaatcagaaagggagaagctcaaaagatacgaaggttgacacagtgccgaagctgtgaagcaggaaagcttcggcatgttcgcagaaaggggaaccgacttaaagatgaaaaggccatttagacctcgatagaatgctatagaattatcaccaaatgtaaagggcatgtatgtaattttgtatgggttgtaccccgtgcctataaataggagaacagtacccccgtactgttcacgcggacttagcatttgcttttgcgtcacacttgtattttcatttccttccaagccgaaggtacatttataattcaatattgtttctattcctctatgatgagttaataaagttaaatgaataatgttatacgattattcacgctatcttttatgtttcatatgcttcgtccttactaatgtatattatagtgatgaaagttaatccttcatgaccttcgtccggggatcgttatatcctaagggaaataatgcttcgaaggacgaaggatcttaatgtttaacattttctgtgttgccttgttcttaactcatagcatttgagaacaagtccccaacattggcgcccacctccggtgaactcacttccacttcgagtcttcgtgaacaccttcggaagctatagaccttcgctatggcgccgaagaaagcttcagcggctggggctgcagcactacaaccgctggaccacaaccaggagaccgtctctcttcgggaggccagaagccagaagagaaaagctgttagcccgacgcttgaggaagaagagctagaccaagaaatcagagagatggagatgctacatcaacaagtgcagaggaagaaggagaagatggcccgcctagctgagttgcaaaggcaaattgacgaagcttctgaggaagttcgccatctcactcacgatgagcagaacagaaggcctcatcagaaagaccttcatcaggagggcttcgtcaacgaagacgactggtatgataatttccatcagggaaattttgtttttgatgatgcttctcctctgtctgctgagctgcaggctactccttggcctccatcctataagccaccccagctccccatgtttgacggccactccgacccgaagcaattcttgatgagctacgaagcaacagtgtcttcgtacgggggcaacgctgcagtcatggcgaagtctttcgtcatggccgtcaggaatgttgctcagacctggtattcctcccttcggccaggaacaatcacttcatggcagaagctgaaggatatgttactgaccagctttcaaggatttcaaacgaagccggttacagctcaagccctcttccagtgtattcaggatcacgaagaataccttcaggcgtatgtccgaaggttcttacgattgagggcgcaggcaccaacggtgcccaatgaaatcgttatcgaagccatgatcaaggggcttcgtcctggacctgcagctcaatactttgctcggaagcctcctcagaccttggagaaattgctccaaaagatggatgagtacattcgtgccgacaatgactttcgccagagaagggaggaggccttcagattttctgagatgaccaggggcttcggagggagatactacccgaggcatgtccgttccattcacagcactcagaatgatgataaggggagtcagcaaaacaggccgcagtgctcctcacaggcttcggggcaacaacaaacttcctttcggccaccagctccaagaggcagaggcgccaggggcttcggcggaagattcggagatcagccaaggagactgttttgcctattctgtggagagggcaagggccacaccactaggacgtgccatgttacaatccagaagcaaaaggaactagccgaagctgcatctcaacaagctcagtcgaagcaggttatgcatactgcttcgtttcatccgccttatgtcccacaatacatagacaaccaccctgcggcttctgtagcttcggcaagtcaacctcaagcttcctggcagcagcttccacctccacctccattgcagcaaggtcaacagccagaagggagtcaatacgctccacagcagagggacttcagagaacagtccgaagctcgcacagtcaacagcactgtgccagagtcgaagcacatttattgacatatcctacctttgatagcagtcttttctattcagttttgttttctgtgaagcaaaaaacattgatagtttccatgtaataatttcgttgtttccacgagaaaaatttatttgattcacaggcctaagttgccgaagcctgaaatttcttccgttaccaagaaggaccttcggactaaaaatccttcggagtaacaaaaagtcgttctaaggaacgcagagtaagtttataaagtcacaaaaagtcgttccaaagggagcgcagcgtaagttttctgctcagaagtcgttcctaaaggaatgcagagcctacagcgaaaaatcaacgctgataccgtctaagtaaaagacgaagaagctcctaagggaggcttacagcgaaaagtcaacgctgataccgtctaagtaaaagacgaagaagctcctaagggaggcttacagcgaaaagtcaacgctgatgccgtctaagtaaaagacgaagaagctccaaagacgttcctaagggaatgcagagcttacgaatatattttatgtgtatcttcggaacaaatgtcacatgcataacataacatcatcacatcattttgcatagcataagcatcatacatcatatcgcatttggcaagagaaggggacactctcaaccttcgaagggatgctttgaaaaagtgacattgaaattgtatagcttcggaatacagtttcggggaatattttcacgaaacatgggcgaactttatcagatcaatatcaaagttgcatagcttcggaaaatagcttcggaaaatgttttcacgaggcatcgatgtcattcatcagaataattttgacgaaggctatcttcttcacgacgcatgaaaagaagggaaggtgttttttcgccgaaggctcaaaagtggtatgtatttaaagtttcatgcatcgtaaagaattcaataatgaaaagagacttgtatattacattcaaatgtacaaagtgttgcatagattacactttaaatgttttttccaaatagcacctaatcttccctcaatactgcttcggcggcttcattcagaagttggtcaacaaccttgtccatgatagtttcggccatttgattaatttcttcatccccttttgtgtgggggtcggcagatcgtccaacagtttctgagcgaagagaacacttcttcagtacttttacaaatcgtgagcaaagtttaaaatgaaaattacaacgcaacaagaacgactagttggtacctaactgtccttcgggctcactactcctttcggcagcgtctgctactcttctagcatcgtgaatgcctttttcgcttctttcaatgatctcccgcgccattcctcggccgccgtcgttccagatatcagtaaaaaatttgccaccaaccacgctcgcttcggccgaggggtccttgatgtcttcggtagataaggtagcttcggattgagctaaaaattttacatgttcgcaacctttcttctctaagacggaagcaattcctctggcgcccgaaaaagcacatatgtcgccacgactgttcagaatctcttcgaaggcctctgcttcgtggctaatccattccagcggaccttcgggattgcctcgagagaaattctcttcgctggaaaaggcgcctacgctggcgaagctggatttaattttattcacacattctacagatttgacatagcatttcccctgagatgtgcgaagctccttaacttttgattccaatttgttgaccataaaatcactaagttctcgtttcgtttcctcaagcgcgcgctcctctttagctctagccagctgtttctgaagatctttaatctcgcgtttttgagcttcggcctgggcctttgaagcagcttcgtcttttttcactttatctaccagtgtaagtagaattttatctttttccaaagcttcgtttctcagtttgataacttcggagcgtaaattattaaacgcaatttcataactttcatcttcggcgctcttttgcgctcttaacgcgttgcttaggatcaggccctatatgaaaaaagaattcatataagagaaaaggaatgagttgcgtaaaaaaaaagatagggggtttttttctcaagtgtttaattcccgtaccttcaggctgttgtacgcgaggctgtctgcgagatcctctttcgtcatggcacttaacccagcttcaagcttcggaaagcctatgcttctcgccatctctcggcagacggatagctctttgttatcaggcaggcagtataagaagtcatcttcatttgttccattgaatattactgcccccttcggatatttcagctcctttgcataatggttggcctcatgagtttcttcctcagatagctttttccccgaagcatgtcgtatgatgtaatcatgcatgccggcaggtgcttcggggatgacggtgtccgtttcttcaactaatattggttccggaatttttactgcttcggcttcaaaaggatgttctttgaagggctctgaaggcccagcttcagcttcagcttgttgagccaaagcttcagtagaagcttcagcaacttcaacactcttttttggaattgtgcttgaagacttaattgtctccaagacgtctagtacatttaccattcttttcctttttggggtcactgatggccccttttggttttttgctgtcccaatgattgctgtaggactcaaaacttctgatgttttggagccctcagttgcttctcttacctcctcaattttttctgtgagcggcgcttcggttttctcttttgtttctgacaacaaaatgtttgattgttctgattctatctttggtggcacttcggccgtttctgcgatctctggcaacaaggctggctcgattagtttttcagcttcggtggctgaagaagtcttcccggtaaactccggcaccgaagctggttcaatataacgaggccgttgcgtaagaacctttatctttttccttttgggttctggctcgctaggagcagctgcagcttcttcttttgcagagattgtgttttttctcttctgccttcgaatgggatagcagtaatcagggtagacaaacccaatggcatcaaatacccgattcagtctcttcttttttcggcctccgaaggctgctgacattgcattatcttcagccttcgagtaggtcccgagtagctcatcacttaaattgtcaatgcttttcaaccactcatcatctggctcaataaatttatctccaaatttgaacgtgtacttcagtctcacaagctcaccttcgtcggcctcttttatggtttcttgtggcatttcccatttctcagcaagcggccacaccctgaaggcgatatgttcttgtactaagtcccttgttcctataaaagagcagacaacgccgaaggctctttggcactcttcggcggcttcgttcatttcaaccttcggcctccgaaggccgaagctttgccaaataggacgcataattatacctttgatgtcttctcgtgctgataagtcattcttcacataaaaccattctgtcatccaatccccgggccatctcttccgaaaggttggtacgggacagcttgccccggaccgagaaacgaagctgtagcagccaaagttgttatggtactgttctttgccccaaggctttgtttcatataataattcatgaacattacaaaagcttcttgcgtcaggcttcagaccttgactcctcgcggcccacacgaagatatttagccttataattgcctcgggagtaagttgatgaagatagacttcgaagattttcaacacctccacgacgaagctgctcaaggggaatcgcaatccagctttcaaaaagcttcggtacaccacaacttcattttcttcagggtgtggacaagttttttccccttcgtccgccctcacaatagacagatcccggaaataccttcctctcatattaacaagatgattctctttgatagttgacttaccataaactgaatggcttggtcgccaggggcgatcttcggagtcttcgccaccgctgtccatatcataactttcactgtcaccagtatcttcagacagcccctccagaatttccttggtaatcttttctgtgttggacttcgacatcgctataagaaaccctaggttcttctcttcatcaagactcagcttcatctcagcagcagccttcttagcagcttcagacatcttcggaagcgctaaaaaactgtttctaaaagccgaagcttcaaagctaaaaacttagcagatcacagtgcacaagagctaaaaaatgagtgagcaggagtggttggccagaaagcgtgcaaaataagtttgcggtatggccgtatttatacgcttgatgcgttgaaagttgaaagaccccacttgtcattgaatgttgctattctagcaaagggaaggtgttttttcggaccttcggcataaagccttcgttcatatcgcaatctgaatttattatttcaaacaaattaatattgcgaggggctactgttgggggccttcggcttccgaaggtcctcaaaaacatgatttaacaatgtttctagagtataatgtgtgaacaggtatcttcggacttgaatcagaaagggagaagctcaaaagatacgaaggttgacacagtgccgaagctgtgaagcaggaaagcttcggcatgttcgcagaaaggggaaccgacttaaagatgaaaaggccatttagacctcgatagaatgctatagaattatcaccaaatgtaaagggcatgtatgtaattttgtatgggttgtaccccgtgcctataaataggagaacagtacccccgtactgttcacgcggacttagcatttgcttttgcgtcacacttgtattttcatttccttccaagccgaaggtacatttataattcaatattgtttctattcctctatgatgagttaataaagttaaatgaataatgttatacgattattcacgctatcttttatgtttcatatgcttcgtccttactaatgtatattatagtgatgaaagttaatccttcatgaccttcgtccggggatcgttatatcctaagggaaataatgcttcgaaggacgaaggatcttaatgtttaacattttctgtgttgccttgttcttaactcatagcatttgagaacaagtccccaacatcgggctctgttccttgtcaccacaccatgctcatcttgcttgttgcggaagacccacttggttcctacaacattttggttaggacgtggaactaaatgccaaacctcattcctcatgaagttgttgagctcctcttgcattgccaacacctaatctgaatcccttaatgcgtcttccaccctgtatggctcaatagaagacacaaaggagtaatattcacaaaaatgagcaacacgagatcgagtggttacccccttatgaatatcgccgaggatggagttcacggggtgatctcgttgtattgcttggtggactattgggtgtggcggtcttggatcctcatcatcttccttgtcttgaccatgggcatctcccccttgatcaatgtcctcctcttgaggtggctcattttcttgatcttcatcttcatcctcttgagcttgatcctcatcttgagttggtggagatgattgagttgaagatgatggttgatcttgtgcttgtggaggctcctcggattccttagggcacacgtccccaatggacatgttccttagcgcgacgcacgaagcctcttcatcatctagctcatcatgatcaacttgctctacttgagagccgttaatctcatcaaacacaatgtcacaagaaacttcaactagttcagtggacttgttaaagactctatatgcccttgtgtttgaatcataaccaagcaaaaagccttctacagccttaggagcaaatttagattttctacctattttaacaagaataaaacatttgctaccaaagactctaaaatatgaaacattgggctttttaccggtgaggagttcatacgatgtcttcttgaggattcggtgaaggtagagacggttgatggcatagcaagcggtgttgattgcttcagccgaaaaccggtctgaagtcttgtactcatcaagcatggtcctcgccatgtcaagtagagttctattcttcctctccactacaccattttgttgtgacgtgtagggagaagagaactcatgcttgatgccctcatcctcaagaaaaccttctatttgtgagttcttgaactccgttccgttgtcgcttctaatctttttgatccttaggctgaactcattttgagcccatctcaagaatccctttaaggtctcttgggtttgagatttgtcctgcaaaaagaacacccaagtgaagcgagaataatcatccacaattacaagacaatacttactcccgccgatgcttatgtaagctatcgggccgaataggtccatgtggagtagctcaagtggccagtcggtcgtcatgatgttcttgtgtggatgatgaacaccaacttgctttcctgcttgacatgcgctacaaaccctgtctttctcaaaatgaacattggttagtcctaaaatgtgctctccctttagaagcttatgaagattcttcatcccaacatgggtgttgggggccttcggcttccgaaggtcctcaaaaatatgatttaacaatgtttctggaagtataaagcatgaacaggtaccttcggacttgaattgaaaccatagcgtgaagaagcacgaaacaagagcgaaggatggaacagagccgaagctgtgcgcaaggaagcttcggcatgatggcagaaaaaaggaaaccgacttaaagaggaaaagactatttagaccccgatagattactatagaattattatcaaaagcaaagggcttggatgtaattttgcatgggctgcgacccgtgcctataaatagatgaacagtactcccgtattgttcacgctgacttggcattcgctttcgcatcgcgcttgtactcttcctttccttcgagtcaaaggtacatttataatttattattgttgatacagtgagacaaataaaaataagttgataataatgtttgaagtgtttatgttattttccatattttgtatatgaatccttcttcatcatttattgtgtttatgaaggcatgtacttcataaccttcgtccgaaattcattatatccgaagggagataatgcttcgaaggacgaaggactttaacgtttgacactttctatgttgccttgttcttaattctaagcatttgagaacaagtccccaacaatgggctagtcggcggtgccagagccaacccatgttagtcttagcaattaagcaaatgtcgagttcatctctattaaaattaactaagtatagctgaccctctaacactcccttaaatgctactgaatcatcacttcttctaaagacagtaacacctatatccgtaaaaagacagttgtaacccattttgcataattgagaaacagaaagcaaattgtaatctaaagaatctacaagaaaaacactggaaatagaatggtcaggtgatattgcaattttaccaagtcctttgaccaaaccttgatttccatccccgaatgtgatagctcgttggggatcttggtttttctcataggaggagaacatccttttctccccagtcatgtggtttgtgcacccgctatcgatgatccaacttgagcccccggatgcataaacctacaaaacaagtttaggccttgttcttaggtacccaaacggtcttgggtcctttcacattagaaacaagcaccttgggtacccaaacacaagtctttgagcccttgtgtttggccccaacatatttggcaactactttgcctgatttattagtgagcacataggaagcatcaacagtcttaaatgaaatgttatgatcatttgatgcaatagtagttttcttcttaggcattttaacatgtgtagaacgcctagagctagaagcctcattcttgtaaataaaagcatgatgagaatgagtcttctttgcatgaattctcctaatcttatcctcaggataaccagcaggatacaaaatataaccctcgttatcctgaggcatgggagccttgcccttaacaaaattggacaatcttttaggagggacattaggcttgacattgtctccctgttggaagccaatgccatccttaatgccagggcgtctcccactataaagcatactacgagcaaatttaaattttccattctctagttcatgctcggcaattttagcatctagtttagctatatgatcatttttgttgtttaatcatagcaaggtgatcatgaatagcagctacattaacatctctacatctagtgcaaatagaaacatgatcaaccgtagatgtagagggtttgcaatcatttaattcaacaatcttagcatgtaaaatagcattctcatttctaagattggaaatagaaacattgcaaacatctaattccttagcaattaatttatcattctcaaacttaaggctagcaagagattcattcaacttgtcaatcttagcaattaaactagcattatcatttctaagattaataattgaatcatcacaaacatttgatttctcaaccttagcaattaatttggcattttcatttctaaggctagaaatagtgtcatggcaagtgctaagctcactagttaatttttcatttttctctacctcctgagcataagcatttttagtcttaacatgctttttgttttccttaataaggaaatcctcttggctatccaagagttcatccttctcatgaatagcactaatcaattcatttaatttttcttttgttgcatgttaagattgacaaaaagagtaagcaagttgtcctcatcatcactagaattatcctcatcactagaagttgcatacttagtggaggatcttgatattaccttcttcttcttgccgtcctttgccatgaggcacttgtggccgacgttggggaagagaagacctttgttgacggcgatgttggcggcatcctcgttgtcggaggagtcggtggagctctcgtccgagtcccactcccgacaaacatgggcatcaccgcccttcttcttgtagtacctcttcttctccttcttcccactcttgtcgttatccctgtcactatcactagacaaagggcatttagcgataaaatgaccgggcttaccacatttgtagcatactttcttggagcgaggcttgtagtccttccccctcctttgcttgaggatttggcggaagctcatgatgatgagcgtcatctcctcattgtcgagcttggaggcgtcgatggggaccctacttggtgtagaatcttctttcttctcctctgtcgccttgaatgcgacgggttgtgcctcgggtatggaggaggcgccttgctcgatgattttctttgagcctttgatcatcaactcaaagttcacgaattttcctatcacttcctcgggagacattagtttatatcttggatcaccacgaattaattgaacttgagtagggttaagaaaaacaagtgatctaagaataaccttgaccatttcatggtcatcccatttagtactcccgaggttgcgcacttggttcaccaaggtttttagccggttgtacatggcttgtggctcctccccttggttgagcatgaatcgaccgagctccccctcgatcgtctctcgcttggtgatccttgtcacctcatctccttcgtgcgcggttttgagcacatcccaaatatctttggcggtctctaatccatgcactttgttatactcctctcgacttaaagaggcgaggagtatagttgtcgcttgggagttgaggtgttggatttgttcgacctcctccgaatcataatccttgtcccccttctttggtacctgcgctccatactcaacaatatcccatatgcttttgtggagtgaggttaggtgaggcctcattttatcactccacatagaataatcttcaccttcaaacataggtggtttgcctaatgggacggaaaataatggagtgtgttttgaaatacgaggatagcgaaggggcatcttactatacttcttgcgctcatggcgcttagaagttggcggatgccgattccgagccagaggtggagggtgacgaagagtcggtctcgtagtagaccaccttcttcatcttcttattcttgttacccttccgttgagacttgatggaggaagaggattcctccttgtgcttgtgggcggactcccttgagtgtgttctcctcgagcttgcggacttgtcgccggtcccgatctccctcatggcggatgctcccgacatcacttcgagcggttaggctctaatgaagtaccggctctgataccaattgaaagtcgcctagaggggggtgaataggcaaatctcaaatttacaaactttaagtacaactacaagccggagttagtgttagaaatataaatgagtctgaaagagagggcgaaaacaaatcacaagcgaataagagcggatgacacggtgatttgttttaccgaggttcggttcttgcaaacctactccccgttgaggtggtcacaaagaccgagtctctttcaaccctttccctctctcaaacggtcacttagaccgagtgagcttctcttctcaatcaaacgggacactaagtccactacaaggaccaccacaacttggtgtctcttgctttgattacaagtgagttggaaacaagaatagaggaagaagtaaagcgatccaagcgcaagagctcaaaagaacacaaaagtctctctctagtcactaatttgtttggagtgatttcggacttgggagaggatttgatctctttgtttgtgtcttggaatgaagtctagagctcttgtatgaggtttgatggctgaaaaacttggatgcattgaagtgtggtggttggggggtatttatagccccaaccaccaaaagaaccgttggtgagggctactgtcgtatggcgcaccggacagtccggtgcaccaccagacactgtccagtgtgccagccacatcaccaggccgttgggttccgactgttggagcttctgacaacggggccaccggacagtccagtggtgcaccggacaggtcctgatcactgtccgatgcgccttctagcccctgctctgacttctgcgcgcgcaggcgcgcactgtagcgtttcactgttcctttgcagacgaccgttggcgctgtttagccgtcactccgctggcacaccggacagtccggtgctacaccggacagttcggtgaattatagcggagtggctcccagaattcccgaaggtggcaagttcggagttgatctccctggtgcaccggacactatccggtggcacaccggacagtccggtgcgccagaccagggcagccttcggttgtctttttgctctttttatttgaaccctttcttggactttttattggtttgtgttgaacctttggcacctgtaaaacttataatctagagcaaactagttagtccaattatttgtgttggtcaattcaaccaccaaaatcatttaggaaaaggtgtaagcctatttccctttcaagcacgaaatgggttgaccatgaaatggtcaaggttattcttagatcacttgtttttcttaaccctactcaagttcaattaattcatggtgatccaagatacaaactaatatctcccgaggaagtaataggaaagtttgtgagctttgagctaatgatcaaaggctccaaacaaatcatcgagcgaggcgccacctccacacccgaggtgcaactcgtcgccttcaaagcgacggaggagaagaaggaatagtctacatcgagtaggcttcccatcgacgcctccaagctcgacaatgaggagatggctttaatcattaaaagctttcgccaaatccttaagcaaaggaaggggaaagattacaagccctgttccaagaaggtgtgctacaagtatggtaagcccggtcatttcattgctaaatgtccattgtctagtgatagtgacaggggcgacaacaagaagggaaagagaagagaaaagagaaggtactacaagaagaagggcggcgatgcccatgtttgccgggagtgggactccgacgagagctccaccaactcctcctccgacgaggacgacgcaaacatcgctgtcaccaaaggccttctcttccccaacgtcgtccacaagtgcctcatggcaaaggacgacaagaagaagaaggtaaaatctagatcctccactaagtatgcaacttctagtgatgaggaaaattctagtgatgatgaggacaacttgctcaccctttttgccaacttaaacatgcaacaaaaggaaaaattaaatgaattaattagtgccattcatgagaaggatgaactcttggatagccaagaggacttccttattaaagaaaataagaagcatgttaaagttaaaaatgcttatgctctagaggtagaaaaatgtgaaaaattaactagtgagctaagcacttgccatgacactatttctagccttagaaatgaaaatgccaaattaattactaaggttgagaaatcaaatgtttgtgatgattcaattgttaatcttagaaatgataatgctagtttaattgctaagattgacatgttgaatgaatctcttgctagccttaagattgagaatgaaaaattaattgctaaggctaaagatttaaatgtttgcaatgattctattaccaatcttagagatgagaatgctattttacatgctaggattgttgaaataaatgattgcaaaccctctacatctacggttgatcatgtttctatttgcactagatgtagagatgttaatgtagatgctattcatgatcaccttgctttaattaaataccaaaatgatcacatagctacattaactgccaaaattaatgagcatgacttagaaaatgaaaattttaaatttgctagaagcatgctctatagtgggagacgccctggcattaaggatggcattggcttccaacagggagacaatgtcaagcttaatgcccctaagaacttgtccaactttgttaagggaaaagctcccatggtttaggataacgagggttacattttatatcctgttggttatctcgaacacaaaattaggagaattcactctaggaagtctcactctggctctcatcatgcttttatgtataagagtgaggcatctagttctaggcaatcaacccatgctaaattgcctaagaagaaaactcttattgcatcaaatgaacctagcaattcatttaagacttttaatgcatcatatgttttgactaataaatcaggcaaagtagttgccaaatatgttggggccaaacacaaaggatcaaagacttgtgtttgggtacccaaggtgcttgtttctaatgtgaaaggacccaagaccgtttgggtacctaagaacaaggcctaaatttgttttgtaggtttatacatccgggggctcaagttggatcattgatagcgggtgcacaaaccacatgactggggagaaaaggatgttctcctcctatgcgaaaaaccatgatccctaaagagctatcacattcggggatggaaatcaaggtttggtcaaaggacttggtgaaatcgctatatctcctgaccattctatttccaatgtttttcttgtagattctttagattacaatttgctttttgatcctcaattatgcaatatgggctacaactgtctatttactgacgtaggtgttactgtctttagaagaagtgatgattcaatagcatttaagggggtgttagagggtcagctatacttagttgattttaatagagctgaactcgacacttgcttaattgctaagactaacatgggttggctctagcatcgccgactggcccacgttgggatgaagaatcttc

SEQ ID NO: 129 - DNA, 3000 bp, Zea mays
  promoter (1)...(3000): ZmPESP(ASK) promoter
tgcatttccttttgtattttttatgagttctcttgggtttacctatcactagttttcgcaagtatgcacaccacatctaactagaatcacctaagtcaaactacccatctcaagtctccctttatactacgactaaaggaaaaaataacgataatatcactgacctaagtgtccaataactttattgacacttagaactagttgttacttaactattttgagtatccatttaaaaaccgaccgttgggtatccatcaacaagggcatgaatgtcgcataagctcaatcgtcctgcaatattatgttctagcttatcttatttctgcaaaaatacacattaatcataataaatcttatgttgttattaatcactagaaccaaacttaggactagatattttttaatctaaagtaactggaagacctaaatattccttttgttttcttatattttgagatctaaaactagatttttcgaatggttaagtatagattgtatcaatgtctaaggtcgttcgatcattttaagttttgaatttcaaaaaaaattctaaaacaatagaacaaatgttcaggattctaaatgtgcttattcgtctatatatggtggttgctttggacttctcgatgggcctgaatctgaccctaaggaaggcctcgattcagcccactaggttcggcagagtttgaagtcgaaggaagaaaacgcagtacatgtacaagacacagatgggcacgctcactccactcgctcgtctcgtctcgtgtcctatggatgcaatgcaagggtatttccagaacacatggcttgcttgtactgggaggaattgggcgcgctgcagggcaggctgcagccagccgagattattgcgagctacgtacagtactctactgtttttaccagtgcaccgtacgcgagggtgtagacgaccaaaggtacggtgtctcccgtacgtgcagcaggatccccacgtttccgacgaagaattttttctctctggtacgtatatttgttgtacgtcgtgcagcctgcagggcgtttgaagacttgttgggctggctcgcatcgcactcgcacccaatcaaaaagaggacgcttccgacgcagcgaaggcacatgcatccagctccagcctcttcgtcgtgaaaaacgtaaaagatcacactcatcgctatcgttactagaagaaaaaaagggtgaatagaaaagaaatcaggaaagtgaccgtttcttttcccttccattattctcttggtgatgaaacacgaccggttctctagcctcgtgcagtcgtggtgcatcgcggccggtttatttggagttgggcgtttgaccaccgagaagtggactgtggccaaaccagctgagcagaggccaccactgacatcgagcatcacgcataataataatgcattaattaatgcccacctgtgggaggctgggggctggggctggggggatggtgctcggctgaagtgaggccggctccaatccatcacagcagcaggccagcagctagccatccaaggtgagtgagtggcgtcttcgctttgtagctgcaccccgccgcagcggcgagtgctcctgtatgaatctaacggtgctttggccgcatcctctccacctccacatccacatccacatccacatccgtggtggatcctagttagttcggtcctccccctccatgcctcccgacgaaaaaagcagcgtgtggtggcagtgacgaccacagcgaaaaaagcggcaattgaaggcgatggtgtggcctggagctggagtgggcgctcatgcaaccgccgccaagtgctgctgccgcaaccgcagtaggccaacgatgtggtgtcgaggcggattcagcatataaaattcacttttatcattgaaattgaattacattctaataataatttagggatatatcaattaagttaatttggttttatgcaaaatatatttgtatattattattagcaagatgtccgaaatctttatatgctatattttttctataaaagagtaagatgaaaagtgtcatgtaagttacaaagtataaacaaattttactaattcataaaatcatttcccaccctccaccctatgaatttgagatatgcttatatctgaactttggaaagtgatggaatgtcaaattccaaactaaataagttattttattgagtgaattctaattcctctaaaatgaagggatccaaacgccacgtacagcgatttcaccccttttctttacttactataaatcactagtttcgacagttattatgtgtcatcacttttacagaagcccctcacatttctttgaaatcaacccaaaatcccaccgtcactcatgtgtcacgcgcggagcgtatatctatttttacccaacgtctcgttttacaaccagataagataaatcttatctccgcacaaccagccatacaatcaccatgagtgtgcgcaaaagcctgtatatatgattttattgtcacatctcgtctaataagataagtattatcttttgcatacggaaccaataatgtaaccactatgagcgtttatattaactctcaacttctatctatatattctttgttatttatttttatgtaaccgttatgtactaacattttattaaatatttatgtgccctcgtaaacacgggtattgtatctagtgtacctaataaattcgctcgccgtggccacaaaatcacgacaacactaaaatacgtacacttggaggtgaagtcaccaacaaaacaagcgtctccctccaccggtccaccccccatctggctctctgcttctgcacctgcgtgtgctagcgcgagcgcgtgcgtcccttccccggcacgagcggcgcacaccgtcacatccgcgctccgttcgccttccagaaaatttaaaccccagcggagccggccacggtcagtcagccgccacacggtctccgacgcgctgcccgctcgcctgccaaacccccaccccctcggcggcg

SEQ ID NO: 130 - DNA, 3000 bp, Zea mays
  promoter (1)...(3000): Complementary strand for ZmDGAT1-2(ASK) promoter
gcgaggaaggttccagaaggtgagggagcggggctttgggggtgcgatactttggggcagcggtggcggtggcgaccttggtgcctggtggggaggggaggagccgaggtgcgtgttttgatgcgggtgttgggccgcgcggcggctgacgcacaaaagcgcgggggcgagatggcggcctcgaaaaggggacacgtggacgggcgagcttgccaggcgtcctctccgtcaccggcttggttggaagggtccggtcgggcgagtcgtcgcaggcagcagtcgggagcgagcctgtctgtctcgtttgatcgatcgttccagccgcgttgaggctgaggatggcacgtccctcttgtggaacgtacctaaagatgggagaaaatcaaacttggggatggagatttgtgtgctccggaaaatccacacctgtaagcaccacctatatcattagtaaacgtgcctcgtacaaaatttaacatattttaaaatcaggattcctacaaacattcaacacgagttgttctaaaacttacatgagcgagagtgaaccgttgatcagggttatttatgtagaacatgtttagttgccatcattaaagagtgtttcggaacacatttttttaaatatcacagaatagaaaatgtcatggcgtaatcttattctttttattatattattatattaaagtactggtttcgatggtcgtcctacatcatatttttaaaaaacatcatcatatttctttataaactaacatgtggttctctttttcatcaatccgtagtacgcacgcacacaacaggcttcgctcagccgtgcgacatccgtggtgtctcgccggttgggtttatcgtcttccaacgactgcacgtaccctccacgcacaacgcggagcctactccagactcatcgtgctctgacgccccacgatctcccaatggttgcgagaaacctccatgcacaacgcagagtctaccgtgaacccttcgctcgcggaccgtccggtgaaatccagtctagcccaagtttggctcttgagccaaactccttcacttcttttttactctctttgtaatgattcctactacttagacaaacatagttagcaacaaaaaaattgactaagagctagaatcatacctttatcactttatttcaaaatagtttgcaatatgctcaagctaagtccaaataatgccactttactttcacaaacaagttagtagccaaacaaaggtacaagaaacaaaatatagtgtaagtgcacttattcaaatacttaaaccttctgtttttatagttttacccaaggttacacttttttgtcttccaatccaactcattttggacttcacatattcaattttcttgatttaaacctatgctcatgctcatatgaacaatgttagttcaaaatgatgtgttgatcatttaatcaccaaaacaattagaaattgtccaagggcacatttccctttcaatctccctcttttggcgatttatgccaacacatctaaagcaactcaaagctactaacataaccaaatatgagccaacttttgcaagttgaagtcaaatcaaacatcaattgaatatgtataggatttgacatatgtggatcattttgccaccactcgttttgaattttgcaatcaaactcatttttctcacttttaagtcaaaaactcttttggttttgcaactcaaacaatttttagaaattagttttgatcaagtgccaaaaactcccccttttccataataaagtattctcccccataagagtagttttgcaataagagagctcctctttgcaatcaagagggtcagaacggagttgagtcggacttggcttactcttgttgtgaacgtcctagcttctcctccttaacatgttggcctttcccaagttcttgctagcccactctaaggttcctaaacatcaaaagattcatgacaccaagcataagctctaaaacactattgactaggttagaactaacctggagatttagttgttgtgcacctgctcgtgttgccggtccatatattgttttgtatggaagtgatgtcctcatcaaactgggatcgccaccacctagcagaaactaggtccctctagggtggtctcaaggactccgtcttcatcgacattttcccttccacggtggttgtcgaaggcatgcgccctttcgttgggtgttaaggcggtgcctttactccgtggcataggcccactcaagggtgtctttgcttgttgaagatcccttgtctgctggtgccttcgctatcagtgagccccctcttgcgcgggtctttcgtaaagtcattgttagtggagaccatcgaagggaccttcgttggtgcgggtctggcgaagttctctaacgcgtggaacactacacttaaacatgggttagttccaacctacgcagggctgatcgaggttggcttcggccttcgctccaacaatcaccgcactccaatcgccaccgagccatatagatgttgattgccaagagtaacaagcactagactttcacttggccaagataagcctaatgtgggtggtggatgcacacaaatctctctttagacactaatgaggttgctaatcacaagatccacatttctctaatctcctcacggtgctaagcgttttcgtttctctcaaaaggttgctttagctgttgaaaggggcaagacatcttaagaagcaatggacacatcctgtgctactgcaaactgtgcaaggcatgctttatctattttttgtgtttccttccaaattttgtgtgggctctcttggattacctgtcactagtatttttctaagtgcataccacacacataactagactcgtatgtgtcaagttacccatctcatgccatttttatagtatgactaaaacaaaataaatgtcctttcactactctaagcagtggcgtaggcgtgtagctagagggtgagctgggtggaccgtcgcataccttatagg

SEQ ID NO: 131 - DNA, 1768 bp, Zea mays
  CDS (164)...(1328): ZmFAD2-1
cggcctctcccctccctcctccctgcaaatcctgcagacaccaccgctcgtttttctctccgggacaggagaaaaggggagagagaggtgaggcgcggtgtccgcccgatctgctctgcccgacgcagctgttacgacctcctcagtctcagtcaggagcaagatgggtgccggcggcaggatgaccgagaaggagcgggagaagcaggagcagctcgcccgagctaccggtggcgccgcgatgcagcggtcgccggtggagaagcctccgttcactctgggtcagatcaagaaggccatcccgccacactgcttcgagcgctcggtgctcaagtccttctcgtacgtggtccacgacctggtgatcgccgcggcgctcctctacttcgcgctggccatcataccggcgctcccaagcccgctccgctacgccgcctggccgctgtactggatcgcgcaggggtgcgtgtgcaccggcgtgtgggtcatcgcgcacgagtgcggccaccacgccttctcggactactcgctcctggacgacgtggtcggcctggtgctgcactcgtcgctcatggtgccctacttctcgtggaagtacagccaccggcgccaccactccaacacggggtccctggagcgcgacgaggtgttcgtgcccaagaagaaggaggcgctgccgtggtacaccccgtacgtgtacaacaacccggtcggccgggtggtgcacatcgtggtgcagctcaccctcgggtggccgctgtacctggcgaccaacgcgtcggggcggccgtacccgcgcttcgcctgccacttcgacccctacggccccatctacaacgaccgggagcgcgcccagatcttcgtctcggacgccggcgtcgtggccgtggcgttcgggctgtacaagctggcggcggcgttcggggtctggtgggtggtgcgcgtgtacgccgtgccgctgctgatcgtgaacgcgtggctggtgctcatcacctacctgcagcacacccacccgtcgctcccccactacgactcgagcgagtgggactggctgcgcggcgcgctggccaccatggaccgcgactacggcatcctcaaccgcgtgttccacaacatcacggacacgcacgtcgcgcaccacctcttctccaccatgccgcactaccacgccatggaggccaccaaggcgatcaggcccatcctcggcgactactaccacttcgacccgacccctgtcgccaaggcgacctggcgcgaggccggggaatgcatctacgtcgagcccgaggaccgcaagggcgtcttctggtacaacaagaagttctagcgctcgcagagctgaggacgctaccgtaggaatgggagcagaaaccaggaggaggagagtactcgccccaaagtctccgtcaacctatctaatcgttagtcgtcagtcttttagacgaagagagatcatttgggcacagagacgaaggcttactgcagtgccatcgctagagctcatcaagtacaagtaggcaaattcgtcaacttagtgtgtcccatgttgtttttcttaggtccgctgctgtaggctttccggcggcggtcgtttgtgtggttggcatccgtggccatctgtgcgtgcgtggccgcgcttgtcgtgtgcgtctgtcgtcgcgttggcgtcgtctctgtgctccccgtgtgttgttgtaaaacaagaagatgttttctggtgtctttggcggaatcagatcgtccgaacgaaaaaaaaaaaaaaaaaaaa

SEQ ID NO: 132 - protein, 387 aa, Zea mays
  ZmFAD2-1
MGAGGRMTEKEREKQEQLARATGGAAMQRSPVEKPPFTLGQIKKAIPPHCFERSVLKSFSYVVHDLVIAAALLYFALAIIPALPSPLRYAAWPLYWIAQGCVCTGVWVIAHECGHHAFSDYSLLDDVVGLVLHSSLMVPYFSWKYSHRRHHSNTGSLERDEVFVPKKKEALPWYTPYVYNNPVGRVVHIVVQLTLGWPLYLATNASGRPYPRFACHFDPYGPIYNDRERAQIFVSDAGVVAVAFGLYKLAAAFGVWWVVRVYAVPLLIVNAWLVLITYLQHTHPSLPHYDSSEWDWLRGALATMDRDYGILNRVFHNITDTHVAHHLFSTMPHYHAMEATKAIRPILGDYYHFDPTPVAKATWREAGECIYVEPEDRKGVFWYNKKF

SEQ ID NO: 133 - DNA, 1170 bp, Artificial Sequence
  misc_feature (1)...(298): Zea mays FAD2 truncated nucleotide sequence region 2
  misc_feature (299)...(446): Zea mays FAD2 truncated nucleotide sequence region 3
  misc_feature (873)...(1170): Nucleotide sequence complementary to FAD2 truncated nucleotide sequence region 2
  misc_feature (447)...(872): Intervening sequence
  FAD2 inhibitory polynucleotide sequence
ccggtggcgccgcgatgcagcggtcgccggtggagaagcctccgttcactctgggtcagatcaagaaggccatcccgccacactgcttcgagcgctcggtgctcaagtccttctcgtacgtggtccacgacctggtgatcgccgcggcgctcctctacttcgcgctggccatcataccggcgctcccaagcccgctccgctacgccgcctggccgctgtactggatcgcgcaggggtgcgtgtgcaccggcgtgtgggtcatcgcgcacgagtgcggccaccacgccttctcggactagccgctgtacctggcgaccaacgcgtcggggcggccgtacccgcgcttcgcctgccacttcgacccctacggccccatctacaacgaccgggagcgcgcccagatcttcgtctcggacgccggcgtcgtggccgtggcgttcgggctgtacaagctggcggcggcgttcggggtctggtgggtggtgcgcgtgtacgccgtgccgctgctgatcgtgaacgcgtggctggtgctcatcacctacctgcagcacacccacccgtcgctcccccactacgactcgagcgagtgggactggctgcgcggcgcgctggccaccatggaccgcgactacggcatcctcaaccgcgtgttccacaacatcacggacacgcacgtcgcgcaccacctcttctccaccatgccgcactaccacgccatggaggccaccaaggcgatcaggcccatcctcggcgactactaccacttcgacccgacccctgtcgccaaggcgacctggcgcgaggccggggaatgcatctacgtcgagcccgaggaccgcaagggcgtcttctggtacaacaagaagttctagtagtccgagaaggcgtggtggccgcactcgtgcgcgatgacccacacgccggtgcacacgcacccctgcgcgatccagtacagcggccaggcggcgtagcggagcgggcttgggagcgccggtatgatggccagcgcgaagtagaggagcgccgcggcgatcaccaggtcgtggaccacgtacgagaaggacttgagcaccgagcgctcgaagcagtgtggcgggatggccttcttgatctgacccagagtgaacggaggcttctccaccggcgaccgctgcatcgcggcgccaccgg

The invention claimed is:

1. An isolated polynucleotide comprising a nucleotide sequence selected from the group consisting of:
   a) a nucleotide sequence encoding the polypeptide set forth in SEQ ID NO:48;
   b) a nucleotide sequence encoding a polypeptide having at least 95% sequence identity to SEQ ID NO:48, wherein expression of said polypeptide in a plant or plant part thereof increases the oil content or oleic acid content of said plant or plant part, and wherein said polypeptide comprises a phenylalanine residue at the amino acid position corresponding to residue 469 of SEQ ID NO:48;
   c) a nucleotide sequence comprising at least 12 consecutive nucleotides of SEQ ID NO:47 or a complement thereof, wherein said polynucleotide can detect a polymorphism in a marker locus associated with high oil content and/or high oleic acid content, and wherein said nucleotide sequence further comprises nucleotides 1405-1407 of SEQ ID NO:47.

2. The isolated polynucleotide of claim 1, wherein said sequence is set forth in SEQ ID NO:47.

3. An expression cassette comprising the polynucleotide of claim 1, wherein said polynucleotide is operably linked to a promoter that drives expression in a plant cell.

4. A method of producing a plant or plant part thereof having a phenotype selected from the group consisting of increased oil content, increased oleic acid content, increased oleic acid/linoleic acid ratio, and any combination thereof, said method comprising introducing into said plant or plant part thereof the expression cassette of claim 3, wherein expression or overexpression of said polypeptide encoded by said polynucleotide within said plant or plant part thereof increases the oil content of said plant or plant part, increases the oleic acid content of said plant or plant part, increases the oleic acid/linoleic acid ratio of said plant or plant part, or any combination thereof.

5. The method of claim 4, wherein said polynucleotide is stably integrated into the genome of the plant or plant part.

6. A plant or plant part thereof comprising a polynucleotide operably linked to a promoter that drives expression in said plant or plant part, wherein said polynucleotide comprises a nucleotide sequence of claim 1.

7. The plant part of claim 6, wherein said plant part comprises a cell.

8. The plant of claim 6, wherein said plant is a monocot.

9. The plant of claim 8, wherein said monocot is maize, wheat, rice, barley, sorghum, or rye.

10. The plant of claim 6, wherein said plant is a dicot.

11. The plant of claim 10, wherein the dicot is soybean, Brassica, sunflower, cotton, or alfalfa.

12. The plant of claim 6, wherein said polynucleotide is stably incorporated into the genome of said plant or plant part.

13. A transgenic seed from the plant of claim 6.

14. A transgenic grain produced from the plant of claim 6.

15. A method of increasing the level of a polypeptide in a plant or plant part thereof, comprising introducing into said plant or plant part a polynucleotide comprising a nucleotide sequence of claim 1.

16. The method of claim 15, wherein said polynucleotide is stably integrated into the genome of the plant or plant part.

17. The isolated polynucleotide of claim 1, wherein polypeptide has at least 98% sequence identity to SEQ ID NO:48.

18. An isolated polynucleotide comprising a nucleotide sequence selected from the group consisting of:
   a) a nucleotide sequence encoding the polypeptide set forth in SEQ ID NO:52;
   b) a nucleotide sequence encoding a polypeptide having at least 95% sequence identity to SEQ ID NO:52, wherein said polynucleotide encodes a polypeptide that when overexpressed in a plant or plant part thereof increases the oil content or oleic acid content of said plant or plant part.

19. The isolated polynucleotide of claim 18, wherein said sequence encoding SEQ ID NO:52 is set forth in SEQ ID NO:51.

20. The isolated polynucleotide of claim 18, wherein said polypeptide comprises the sequence set forth in SEQ ID NO:52 with a phenylalanine insertion between the tryptophan residue at amino acid position 467 of SEQ ID NO:52 and the phenylalanine residue at amino acid position 468 of SEQ ID NO:52, or a phenylalanine insertion between the phenylalanine residue at amino acid position 468 of SEQ ID NO:52 and the phenylalanine residue at amino acid position 469 of SEQ ID NO:52, or a phenylalanine insertion between the phenylalanine residue at amino acid position 469 of SEQ ID NO:52 and the serine residue at amino acid position 470 of SEQ ID NO:52.

21. The isolated polynucleotide of claim 20, wherein said sequence encoding said polypeptide comprises the coding sequence set forth in SEQ ID NO:51 with a TTC codon inserted immediately following nucleotide (nt) 1401, 1404, or 1407 of SEQ ID NO:51.

22. An expression cassette comprising the polynucleotide of claim 18, wherein said polynucleotide is operably linked to a promoter that drives expression in a plant cell.

23. A method of producing a plant or plant part thereof having a phenotype selected from the group consisting of increased oil content, increased oleic acid content, increased oleic acid/linoleic acid ratio, and any combination thereof, said method comprising introducing into said plant or plant part thereof the expression cassette of claim 22, wherein expression or overexpression of said polypeptide encoded by said polynucleotide within said plant or plant part thereof increases the oil content of said plant or plant part, increases the oleic acid content of said plant or plant part, increases the oleic acid/linoleic acid ratio of said plant or plant part, or any combination thereof.

24. The method of claim 23, wherein said polynucleotide is stably integrated into the genome of the plant or plant part.

25. The isolated polynucleotide of claim 18, wherein said polypeptide has at least 98% sequence identity to SEQ ID NO:52.

26. An isolated polynucleotide encoding the polypeptide set forth in SEQ ID NO:48.

27. The isolated polynucleotide of claim 26, wherein said polynucleotide comprises the sequence set forth in SEQ ID NO:47.

28. An isolated polynucleotide comprising a nucleotide sequence encoding a variant of the polypeptide set forth in SEQ ID NO:52, wherein said variant comprises the amino acid sequence set forth in SEQ ID NO:52 with an insertion of a phenylalanine residue at a position located between a pair of residues, wherein the pair of residues corresponds to a pair of residues within SEQ ID NO:52 selected from the group consisting of:
   a) the tryptophan residue at amino acid position 467 of SEQ ID NO:52 and the phenylalanine residue at amino acid position 468 of SEQ ID NO:52;
   b) the phenylalanine residue at amino acid position 468 of SEQ ID NO:52 and the phenylalanine residue at amino acid position 469 of SEQ ID NO:52; and
   c) the phenylalanine residue at amino acid position 469 of SEQ ID NO:52 and the serine residue at amino acid position 470 of SEQ ID NO:52;
wherein expression or overexpression of said polypeptide in a plant or plant part thereof increases the oil content or oleic acid content of said plant or plant part.

29. The isolated polynucleotide of claim 28, wherein said sequence encoding said variant comprises the coding sequence set forth in SEQ ID NO:51 with a TTC codon inserted immediately following nucleotide (nt) 1401, 1404, or 1407 of SEQ ID NO:51.

30. An isolated polynucleotide encoding the polypeptide set forth in SEQ ID NO:52.

31. The isolated polynucleotide of claim 30, wherein said polynucleotide comprises the sequence set forth in SEQ ID NO:51.

\* \* \* \* \*